United States Patent 12,378,586 (SYSTEMS, METHODS, AND COMPOSITIONS FOR THE GLYCOSYLATION OF CANNABINOID COMPOUNDS) - sequence listing, part 3

SEQ ID NO: 6973 - protein, 372 aa, Ancylostoma ceylanicum
MHAAQEREEVGWNKRVAEALAQAGHDVTVILVQTMEDAEKDVQFSKDVKVHALNASSGITRSDMEDFQKKAVFGKSQFRAKLRMSLTVTLQNKEFMQWLTDQKFDLAFVHMYHTCPIGLVHASKIPSWIWLNSGQLMDNVANAIGVPTPPSYVPREIVVNKETQIFREHWDPEFPDIMDLIKKCPLVMVNSNELYELPRPTLAKVINIGGIGVEYKDAKPLEGEFKKIAESGKGIVVMSFGSVAHAELMPEHWKTAFLKAFAHFPDYEIVIRYGSDDLKDRLPPNVHAHRWLPQADLLLHPNTKVFISHGGYNSLQESINSGVPLVTIALFGDQFKNSKIAAKHGFAVNLKKGTLDEASIVAALKEVLNNEK

SEQ ID NO: 6974 - protein, 342 aa, Pieris rapae
MKEKRIKFGDKAGMFKVTEDVATLLGMVIEEQLKTDGVQQLINDKSKKYDLIIIEACARPAIMFSHLYKAPVIAISSFGMAFGGGHLVGAPTHPILYPNMLHQRLHNLTFWEKFNEFYKHYWIVNMWKSIENKEFRLLKKYFGGDDVLSYEEINKNVDMMFLNIHSMWSHNQPLPPNVISIWGIHKSPPKSLPQDLQAFLDSSKNGVIYISFGSNAPSSMLPPEKIEILINVFSKLPYNVLWKWETDVLPGKSKNIKIAKWLPQSDLLRHPNIKLFITQGGLQSTDEAMNAGVPLIGIPMLGDQWYNVELYEYHKIGVRIELETITEEQLTTVIKTVTNDKR

SEQ ID NO: 6975 - protein, 530 aa, Canis lupus familiaris
MAATILTGFPLLCVCLLLTSGFAEAGKLLVVPMDGSHWFTMRLVVEQLIQRGHELVLIIPEVSWQLGKSSNFTVKTYSTTYNLEELNQMFKNFSYSQWKTQQQSSLFLVLSPLKDSLEHLFLHCKNLFSDPKLVEYIKESSFDAVFLDPFDVCGLIVAKYFSLPSVVFTRGLFCHFFEESTQCPSPLSYVPRPFSMLSDAMSFRERVRNHIFHLEEHLFCHYFLKTPLEVASEILQTAVTPYDLYSHTSIWLLRADFVLDYPKPVMPNMVFIGGINCQEGKTLPKEFEAYVNASGEHGIVVFSLGSMVSDIPEKKAMEIADALGKIPQTVLWRYTGTPPPNLSKNTILVKWLPQNDLLGHPKARAFITHSGSHGIYEGICNGVPMVMLPLFGDQMDNAKRMETRGAGVTLNVLEMTSADLANALKAVINDKSYKENIMHLSRLHKDRPIEPLDLAVFWVEFVMRHKGAPHLRPAAHDLTWYQYHSLDVIGFLLAVVLGVVFITYKCCAFGCRKCFGKKGRVKKPHKSKAH

SEQ ID NO: 6976 - protein, 454 aa, Zootermopsis nevadensis
MSLPWLVTLVLLLLVTQSHGARILGLYPLPSRSHLIVQNALMFELASRGHQVTVVSPFPVKEPIPNYTHITVESDMNDLMGGHVSSNVFDMQSIGPLKMTFFMWLMGEALCDHVLQNDNIQKLIHSKDLHFDLVIVEVFINECVLGFAHKFNAPIIQVCTYGGGNFMADWVGSPNPYSYVPDEFLPYEDKMNFWERMYNTVVGTLRHVGRQLIHVPKQNAVMQKYFNYTDKFPPVWELEYRTSLVLLNSHFSLSYPKPLSPNYVQVGGMHVKPPKKLPQELQKYLDEAPHGVIYFSMGSTLQSSELPESIRKAFLEAFSKFKQRVLWKWETDSLPGQPKNVRLGKWLPQSDILAHPNVRLFITHGGLLSMQEAIYRGVPLLGIPIFGDQGLNMGRAVSAGYGLKIDFVNVTTESLTWAIREIIETPTYVLTFLHFLLSFLLLLLLLLLLLPYQW

SEQ ID NO: 6977 - protein, 215 aa, Cyprinus carpio
KATVNKFCICVFAQVVWRYNGKMPETLAPNTKLYDWIPQNDLLGHPKTKAFITHGGTNGLYEAIYHGVPMVGLPLWGDQPDNLLHMKTKGAAVVLDISSMQSKDLVDALKTVVNNPSYKESIMRLSRIHHDQPMKPLDRAVYWIEFVMRHKGAKHLRVQAHDLSWYQYHCLDVVAFLLSIIALITFLFIKTCQCLFRKCFRNTRPDDKAQKSKKE

SEQ ID NO: 6978 - protein, 513 aa, Photinus pyralis
MWILHWLVGMVVADIVISSKILGIIPTPSYSHQVVFQALWRELSLRGHQVTTITTHPLKDPALTNLTEIDLHFSTELWKKGVAENIFDYKSNPIGSLIKMMSSVFEIQEQQMRHEGVRQLLESEQEFDLAIIEAHATVSHAFVARFNCPHIGMLSYDAPGWLYETIGNPTHPVLYPHDFFDFYEHLPFLQRITSVISDAAFKLMIWYSYPYLDQLVRQYFGPNYPPLKSIMDNTSMLFVNTDPVFYKVRPLMPVVIQIGSGTHIQAPRPLPKELKVMLDNATNGFIYFALGSNVESRGIPLETRRVIIETFSELPYTVLWKFESDLPNKPENVFTSKWIPQQDVLRHPNIKLFITQGGMQSSEEALYSGVPIIGMPFFGDQFGNIGKMVHMGMGLSVDFENLNKGEFKSKILEVIQNPMYRTNVEKVANLARDQPLTGLERAVWWSEYVIRHKGAKHLRSPMLDVPWYQYLLLDVLGVLLLCLGLSLFIAYKFTKGVFRLVFRRFVNYKKKIQ

SEQ ID NO: 6979 - protein, 350 aa, Peromyscus maniculatus
LQNICCYFFYRSNHHTNIKIFEYFVDLCSHLLSRKDIMDSLRKKKFDLLFLDATDPCVFLIAEKLGKQFVAFLPVLFSIIDYGVPNPLSFVPGFGSSLTDQMDFWARVKYFLMFLDSSMKQREILSQYDGIIQEHFAEGSRPVLSELPRKAELWFVSSDFALDFAHPMFPNIIYVGGLTDKPVRPIPPDLEDFIIKFGESGFVLVALGSTATMYQTKELITEMNSAFARLSQGVLWTCKDAHWPKDVRMAPNVKIMDWLPQTDLLAYPRIRLFVTHGGMNSIMEAIQHGVPMVGIPFFGDQAKNMVVIEAKKIGVSVQLETLKAETFARTLKEVIEDKRYAALWGWGLLG

SEQ ID NO: 6980 - protein, 533 aa, Bos mutus
MTAGSQGDRPVILLLLLWALGPSVSQGGKLLVVPVDGSHWLSLVGPLQPLQQKGHDIVVLAPDASIYIKEEAFYTLKRYPVPFRREDLEETFISLGRTVFEDDPFLKRVIKTYQKIKKDSALLLSACSHLLHNKELMASLTASSFDAVLTDPFLPCGPIVAQYLSVPAVFFLNGLPCSLDFQGTQSPSPPSYVPRYLSFNSDHMTFLQRVKNMFITLSESLLCDMVYSPYGLLASEILQKDMTVRDLMSFGSVWILRSDFVFNFPRPIMPNIVFVGGINCASKKPLSQEFEAYVNASGEHGIVVFSLGSMVSEIPEQKAMEIADALGKIPQTVLWRYTGTPPPNLAKNTKLVKWLPQNDLLGHPKTRAFITHSGSHGIYEGICNGVPMVMMPLFGDQMDNAKRMETRGAGVTLNVLEMSSEDLEKALKAVINEKTYKENIMRLSRLHKDRPIEPLDLAVFWVEFVMRHKGASHLRPAAHDLTWYQYHSLDVIGFLLAVTLTVIFITFKACAFAFRKCFGKKERVKKSHKSKTH

SEQ ID NO: 6981 - protein, 532 aa, Fukomys damarensis
MAGPLPAFPRVSAGLFFLALWGLVVGDKLLVVPLDGSHWLSMKDILERLGDRGHEIVVLVPEINLLLKESKHYTRKIYPVNYSREELEERFRSFGNHHFMDRPYVTAALTEYRNTMIVIDMWFFNCQSLLKDSDTLNFLRESKFDALFTDPGLPCGVILAEYLQLPSVYLFRGFPCSLEHVFSNSPNPPSYIPRCYTEFSDHMTFPQRVVNFLVSFLENLIFHCLYSRYEDLALDLLKRDVRLPSLFQKDPVWLLRYDFVLEYPRPVLPNMVFIGGTNCKKIGALSQEFEAYINASGEHGIVVFSLGSMVSEIPEKKAMAIAGGLGQIPQTVLWRYTGTPPSNLAKNTILVKWLPQNDLLGHPKTRAFITHSGSHGIYEGICNGVPMVMMPLFGDQMDNAKRMETRGAGVTLNVLEMTSDDLGNALKKVIYEKSYKENIMRLSSLHKDRPIEPLDLAVFWVEFVMRHKGAPHLRPAAHDLTWYQYHSLDVIGFLLAIVLLVAFVAFKCCAYGFRKCFGKKGRVKKTQKSKTH

SEQ ID NO: 6982 - protein, 533 aa, Octodon degus
MAMASLVPRLLFLGFLVCALRPLGSHAGKLLVVPVEGSHWLSMVGVIQRLQQNGHEIVVVAPEALLYIKEDPSYTLKKYPVPFQKEDVEASFNELGHHVFESLPFLQRMLKTYKKVKRDSALLLSGCSHLVHNKELMASLVESNFDMVLTDPFLPCGPIVAQLLALPAVFFLNALPCGLHFEGTQCPNPMSYVPRSMSTNPDHMTFLQRVKNVLFVLTEKVMCNVVYSPYALLASEILQREVTVQELLASASIWLLRIDFTADFPKPIMPNMVFIGGVNCLHRNPLSQEFEAYVNASGEHGVVVFSLGSMVSEIPEKKAMAIAEGLGRIPQTVLWRYTGTPPSNLAKNTILVKWLPQNDLLGHPKTRAFITHAGSHGIYEGICNGVPMVMMPLFGDQMDNAKRMETRGAGVTLNVLEMTSDDLEGALKKVIYDKSYKENILRLSSLHKDRPIEPLDLAVFWVEFVMRHKGAPHLRPAAHDLTWYQYHSLDVIGFLLAIVLVVAFITFKCCAYGFRKCFGKKGRGKKTHKSKTH

SEQ ID NO: 6983 - protein, 489 aa, Anopheles darlingi
MTQRLSMRCVLLIAVIAATLQSGTNGARILSVNVFPGRSHWQMISAILEELLARGHEVTVITNYARKTPHPNYTEIVISPIYDFWGKSVKVDSLYDLTEISIHSMLMNFLYPLGLETAEYAFTRDNVMHFLRHDNTKFDLLLAEQFYQESYLMLAHKYKVPIVSIGTFGFGHYMGPLMGQMNVWSHVPHEFLPFTDRMSFTQRAYNSLVSFYESILRHWYYMPRQEAMAAKYFSFLPGPLPLVADLERQVSVILLNSYTPLTTTRARVPGLVPVGGLHIKEPKRLPADLQTFIDEAEHGVIYFSLGTNLRSADLPPEKLAIILRVFGSMKQRVVWKFEDERIENLPANVLVRSWLPQSDILGHRNVKVFITHGGLLGTQEGVHRAVPMVGIPIYCDQHLNMNKATLGGYAVKLYFPNITETSLRGALEEVLYNPSYKENVQRVSQIFRDRPVPALQEAIYWIEYVERYKGAPQLRSAGLDLPWSVAGNL

SEQ ID NO: 6984 - protein, 513 aa, Helicoverpa armigera
MMSLALFIFVLSITCNDAARILAVFPVPSISHQVVFRPLTQELARRGHEVTVITPDPVFTNGGAPANLTEIDVHFTYEDWKKFYETTSGDDNDLVKQMEIAFDLINRIFEVQMRVDKVQKILKEQKFDLLLLEACARPALILSHVFKVPVILVSSFGPLIYNSETIGSAMHPLLYPVNFSQRTNNLSKWDKLVELWRLYRIMNVMQQGELEEQVMGKRLFGPDIPPISELKNNVDMMFLNIHPLWDTNRPVPPSVIYMGGLHQKPQKELPTDLKTYLDSSKNGVVYISFGTNVQPSLLPPEKVRILVKVFSELPYDVLWKWDKDELPGRTSNIRISKWLPQSDLLRHPRIKVFITQGGLQSTDEAITAGVPLIGVPMLGDQWYNVEKYVQHEIGVRLDIETLTEEQFKNAITQVIGDKKYRQNIKKFGQIIRDTPIDPLENAVWWTEHVLRHGGARHLRSPAANMSWAEYLELELVITVLSVALGFVLLLSFLLYYSYKHFVLSPEQKKLKDN

SEQ ID NO: 6985 - protein, 519 aa, Halyomorpha halys
MKWLLLLFLTGTLYVEVSPKRILAFFPLIAKSHHYVFRPIIEELTKRGHEIVYVTGYAYEKGPPKGVTQIDIKKYLPFREAEGNVTALIGASAFDSTARFYKFGVKLSHMILSSPPVKELIHSKAKFDAVLMESYAVQEYQSAFIHKFGCVGIEIIPLGDFSWMNEIAGLPSNPSYQLDFKSEATQDMNFIQRLYNTYVVTITTLISYYQQFEMQRIVDQYFTYPGWETRPPLSQLLANRSLILSNSHFAIGYPSPLTSHRKEIGGVNILPNKPLSKDLQKYMDESTDGVIYFSLGSNINVSDPLNEHITQVFINTFRELPYKVLMKWEIEYTGTPPPPNVKLEKWFPQQDILAHKNCILFITHGGLLSLMEAVHFGVPVIGIPFFGDQAKNFFFAEEAGIGKMIRLEEITYERVSNTIKEVLSNKSYKNEIMKKSKIFRDRPEEPVKTAVYWIEHAMKYPNVLTPKSASLSYVQLHLLDVKLFLGTVLLTALYIIWKLLASISRLFKGKPAVRKAKRS

SEQ ID NO: 6986 - protein, 473 aa, Cyprinus carpio
MRLIVCFLSLLAVLGPAECGNVLVWFSDGSHWINLKIVLETLIERGHSVTVLVPDASLFMKAKESDHFSYQPFNASMDEQEVRNFIEEFVYFSVYETDQLNLLQLLMKVYKFASIIQDMSISYCDGILKSPELMDKLRNGMFDIVLSDPMYPCSDIVAEELNVPLVYTFRLSIANVLERMCGRPTSYCEMMGKADIWLIRIYWDFEFPRPFLPNFKYVGGLHCSPAKPLPKDMEEFVQSSGDDGIVVFTLGSLVDKMPKELSNKIATALAQIPQKVLWRYGGEKPDTLGENTRIYKWIPQNDLLGHSKTRAFITHGGTNGIYEAIYHGVPMVGIPLFGDQPDNLVHIKARGAAVRLDNIKTMEPQDLVNGLNTIINNSSYKENAMRLSRIHHDRPVKPLDEAVFWIEFVMRNKGAKHLRVEAHNLTWYQYHCLDVFAFLITILTVVLYVFFIMCKFFIMRCCFRSKNKKSKKE

SEQ ID NO: 6987 - protein, 1887 aa, Blattella germanica
MTSLMSLHSLHGERILALMNLASPSHYIFNRALLVVVASPNKEQKTVPNLSFIFLEKIYDTERYTRDLEELVFWSMWYKTFATFKWGSSMCDKQLNTSGAQTLLNYSSSEKFDLIITEVGWGECFFGFIHKFGYPPVIATSAVGIPPWLSYTMSNPENPSYMPTFLLSYTDHMTLSQRLHNFIINNFVQLVYMYYHIPLQETIARKHFDGHLPAFEEITKNFSIVLVNTVFGLDSARPLLPNIIPIGGMHIKTHPEALPQRKALLEAFSELPQRIVWKFESDSLPGLPSNVKIAKWLPQSDILAHPNIRMFITHCGMMSTMEAAYWGVPIVGVPFFLDQSVNLKKFITKGAGLELDYVTLTKENALKAVTVITPDKEKTPIPNYKLIQLENIYRDIKAVYDYEEFTQWSMWQLTFGLFDWGSMICEMELNSTGAQTLLNYPSSEKFDLIITEVGWGECFFGFIHKFGNPPVVATSGVGVAPWLSYILANPEQPSYIPNFLLGYKDHMTFTQRVYNFIIHNFVDWIYKYYHLPKQESVAKKFFKEEMPPFYDIAKNFSIVLVNTAFGLDNPRPLLPNIIPIGGMHVKTKPDPLPKDIQKFLDEAKDGFIYFSLGSNIQSEGLPEKRRKALLEAFAELPLRILWKFEADDLPGLPPNVKIGKWLPQSGILESSYWGVPIVGVPFFLDQNVNLEKFIARGGGVRLDYITMTKETILKAVRTVLDNDRIDNSVIMTSRLWMWVTLLSLASYHSTNGAKILALMNLVSPSHYIFNRALLIALAERGHNVTVITPDHEKKPIPNYTLIQTENIYSDARDSYDYEEMALWNMWDFGFALYEWGAFMCDKQLNTTGGQTLLNYPSTEKFDLIITEGGWGECFFGFIHKFGYPPVVATSGLGVPHFLSQTLANPENPSYVPNYLSSYTDHMTFGERLHNSILQLYVDWLYRYYNLPLQEAIAKKHFKEEMPPFIDIASNISVFLVNIAFGLDLSRPLLPNVIPIGGMHLKSRPDPLPKDLQQFLDEAKDGFIFFSLGSNLRSENLPEGKRKALLDAFAELPQRVLWKFEADDLPGLPPNLSEKHEETLRNIQGSTTDCTGQSYFLDRIRHQTWRSSPFAFCCWRPLLLVRMASFSFKWMLLLLSITNEHCANGAKILALMNVASPSHYIFNRALLLGLAERGHQVTVISPDNEKKPVPNYTVIQAENIYSDARDSYDYEEMALWNMWDLTFALYEWGAVLCDKQLNTTGGQTLLNYPSTEKFDLIITEGGWGECFFGFIHKFGYPPVVATFGVGVPHFLSQTLANPENPSYMPNYLLSYTDHMTILERLHNFIMQMFVDLIYRYYNLPLHESMAKKYFKDEMPPFIDIASNYSIVLVNTAFGLDISRPLLPNVIPIGGMHVKTKPDPLPKDIKQFLDEAKDGFIYFSLGTNLKSEALPAVKRKALLDAFAELPQRVLWKFESDNLPGLPPNVKIGKWLPQSGILAHPNIRLFITHCGMMSTMESSYWGVPIVGVPFFFDQKVNMQKFVSKGGGVWLDYTTLTKESILKAIRTITQNESIELLTDSTEKMSCSLIWMFLILSLTNYQSASGAKILALMNIASPSHYIFNRALLVTVISPDNEKKPIPNYTVIQTENIYSDARDSYDYEEMALWNMWDLTFALYEWGAVMCDKQLNTTGGQTLLNYPSTEKFDLIITEGGWGECFFGFIHKFGYPPVVATTGTGVPHYLFHTLANPENPSYIPNLLLSYSDHMTFGQRLHNFIIQVFSDWVYINHNLPLQESIAKKYFKDELPPFIDIASNYSLVLANFAFGLDISRPLLPNVIPIGGMHDLKQFLDGAKDGFIYFSLGSNLKSDALPAAKRKALLDAFAELPQRVLWKFESDDLPGLPPNEGNVNNI

SEQ ID NO: 6988 - protein, 427 aa, Acromyrmex echinatior
MRMLLVIFPLLFCLSICHGYRFLGMFPFHGKSHFVMIEQLMKGLAKKGHQVDIVSKFPLKKPYPNYTDIVILPTDVHLVNNVTFEIMHQMLSSNPINVVSTWAGNELCELLGNPEIKELAKPKDPPYDAVFIEVFGAQCYSVFAYTLKVPLIGISTTSLYPWLYDMIAQPENLAFVPNNVRSFIEPMNFWQRLCNVVHTFFDKWHFNYLTTREQDRIIREHFGPDIPSVRELEKKISLVLINSHIALNGIQPRTAAAIDVGGIHVQDGNETLQPELEKWMNDSKDGFIYFTFGSMVMIETFPREFLRILYASLSKLAPMRVIMKIPKPEKLPAGLPENIYTSPWMPQIKILKHPNIKAFITHGGLMGTLEAIVCGVPMIGIPLFADQFTNIDRYVARNVALRLNIDTITEKSFDATLNAILRDPLYR

SEQ ID NO: 6989 - protein, 518 aa, Trichoplusia ni
MRALVYLVLSYICIANEAAKILVVVPTPSISHQVVFRPLTQELVKRGHDVTVITTDPIYSEGTAPANLTEIDLHDISYNIFRQEMAKMPKGNKDVMLLQTEIYFKICVSVFREQLKDKSVQQLIKNKNLKFDLLILEATFRQALVFSHIFKAPVIQMSSLGGVFDNFVTIGAPTHPILYPTIIRQKLNNLTMWEKVTELYNHYMSERIFQNNANLENELIREHFGPEVPTVTELYDNVDMLFLNVYPVFEGIRPVPPSVIYTGGLHQNPEKELPKDLKSYLDSSKNGVIYISFGTNTDPTLLSPERIQVLLKAFAQLSYDVLWKWNGDELPGRTENIRISKWLPQSDLLRHPKIKVFVTQGGLQSTDEAITAGVPLIGIPMVGDQWFNVEKYVQHNIGVRLDFEDLTADTFKNTLLKVIEDDSYRRNIIKLRSLMRDEVQTPLERAVWWTEYVLRHGGAKHLRSPAANISWAEYLELELVLTILAALLTAISLVLSAIYLLYKYFVRNYVAVMKIKSS

SEQ ID NO: 6990 - protein, 425 aa, Lingula anatina
  MOD_RES (417)..(417): Any amino acid
MASKTGMSLAVLYVLLLCSSTSDGARILSLVYPGRSQLGLTVTVLSELKSRGHDVWAVFADTFEISASMLRESGINLLTFRSKEKMFLDDPEVQRDILMAAVENPELRTSLFHITSAIQKMSRIFESYLEEMFVDKELDRKHSLQPITPELSKKHAPGRPYMSTPELMAESELWIVNGGQPAIDHVKPSMPNVMYLGGLMTRPAKPLPKDLETFLKKHGHGVVLVSFGSVIKYMPDRVVQELFEAFKNVPYGVIWKYNGPPLKNVPDHVKIVSWMPQNDILGHPNTKLFITHAGNNGQMEALYHGVPMISIPLFGDQDYNAARAEQKGIAITMDAAFLKSEDLISAINMMMENETYAKNMRRASAIFRDQPGTPVELAGFWIDHVIKYGGSYMKSHARLLPWYQFYMLDVMLVFLAXLFCLLWIT

SEQ ID NO: 6991 - protein, 520 aa, Diabrotica virgifera
MNFSKCLLVFTCFLGCEGAKILGIIPTASYSHQITFHPLWRELALKGHNVTVITTDPLNNSSLANLKEIDLSEIYDLFTTIKFYEIISGDPIYFWRIALLLRKVCFELARLIIEHEEIKNIKNKQFDLVIAEAHFPSIVGFIGHFKCPWIGVSSMESGIQYNVAIGNPAHPVLNPDYNLPLENMENLNFIERLASLVYRVSYVFLINVYIFPTLAAIYKEVGWNAPPMVEVQNNISMLFVTTHPIFHNLRPLLPNTISIGTGMHFKEPQPLPQDLQKFLDDSKTGVIYFSLGSNVNSNLLTTEFKKAVVEAFAEVPHNVLLKMDGEIEGLSKNVMVRKWMPQQDILRHPNIKLFITQGGLQSLQESVVNGIPLIGIPFFGDQITNVNKMVKKGYGVKVDRRSMTKEILVAAIKQVMTNPSYKETAEAMGEIFKDEEIPSLQRAVYWTEYVIRHKGAKHLRSPGIGMPAWKYYMLDVMGFLAFVCLTIIIAIFLILRLFFRWLKYLVKGEAKKTRKTKKKD

SEQ ID NO: 6992 - protein, 534 aa, Caenorhabditis elegans
MRLGTFIFLLTFLFFECYSSKILIFNPIFGFSHVKFISKMADIIADHGHHVTLFQPYHIALKNLDGLVKNKNIEILNYHPTHYEELLKAEPQTFSFFWDSYLVGNPVIGAFLMPKLLGGEFKKTAMEVLSDQKLINELKDRKFDLVIAETFELTGFYLAHLLDVPCIPMMSAVRYPIFNDQFGQPSLLGHVPQIGSAVAGEAGFYDRLNDMFRFFFMGISQEQLNKYQNYFIEEAIGRPVPFWKDLVKQSPIYITNSNPYLDYAVPSTAAIVQVGGITMDLKKLKQVGELPEEYENILKERESTVLISFGSVIRSYEMPESFKAGLIKVFESLPDVTFIWKYEKDDLEFQKRLPKNVHLKKWIPQPSLLADKRVKLFITHGGLGSTMEVAYTGKPAIVVPIFGDQHHNAVMLARHGGAVAYDKFDLKNGEKLTAVVHEMISSTKYQENAEALQHVLFNQPIDPKMNFLNHLDFAIKFPNHRAQVPAINQLGFVAHYYLDVLLFLLVSSIVITYLAISLLKKVLGKCLTKKTKSD

SEQ ID NO: 6993 - protein, 537 aa, Mesocricetus auratus
MDSSLLWASGEMDAGRSGLLLLLCVLAWAEGAKVLVFPMEGSHWLSMRDFSRELHARGHQIVVLGPDVTLHIKGEDFFTLKTYPFPYTEEEYQQKILGNAKKSFEIQGSVEVFFENIAALRNFSELYASSCVDLLHNKTLIQQLNSSFFDVILTDPIFPCGAVLAKYLQIPAVFFLRSIPCDIDSEATQCPNPSSYVPKLLTTHSDHMSFLQRVKNMLYPLTLKYICHISFTPYERLASELLQREVSLVEILSHASVWLFRGDFVFDYPRPIMPNMVFIGGINCANRKPLHQEFEAYVNASGEHGIVIFSLGSMVSEIPEKKAMEIAEALGRIPQTVLWRYTGPKPSNLAKNTILVKWLPQNDLLGHPKTRAFITHSGSHGIYEGICNGVPMVMMPLFGDQMDNAKRMETRGAGVSLNVLEMTVDDLENALKKVINDKSYKENIMRLSRLHKDRPIEPLDLAVFWVEYVMRHKGAPHLRPAAHDLTWYQYHSLDVIGFLLAIVLTVVFIVFKCCAYGFRKCFGKKGRVKKSHKSKTH

SEQ ID NO: 6994 - protein, 519 aa, Vanessa tameamea
MSWVWGTVIALSVFATTEIEGARILAYFPTPSISHQVVFRHITKELARRGHEVTVVTTDPIPKEQEPENMTQLDVHDVSYKHWEELFLMHKGKKQDILHQVNVLFEKLATVVKIQMETPNVRNFLKNKDSKYFDLLLLEAMNRPLIGIAHLFDAPIIHISSLGAVPHQYKNFGAPMHPLIYPTPGSFRSYNLTLWEKGFELIKYLILESTISNALDFDIMIMKKTFGDDVPTIEELAKRIQMLFLNEHPIWAENHPVPPSMVFIGGIHQSEVKELPKDLKNQLDHSEHGVIYVSFGTNVKPSLLPPEKIQIMTKVFSQLKYDVLWKWNNDELPPLSNNTKISKWFPQSDLLKHPNVKLFITQGGLQSTDETINAAVPVIGIPMLGDQWYNVEKFVHHKIGLQLDITTLTEKEFKDAITTVIEDKSYKNNIIRLRTLMREFPVKPLDNAIWWIEHVLKYGGEHLQSPAVRMSWTEYYEINLVLIVLAILVVILVLLSYVLRFVLSIAYNIYITDKKLKSF

SEQ ID NO: 6995 - protein, 208 aa, Operophtera brumata
DLEKLFNESKNGVIYFSMGSNLQSNDMTTEMKQSLLKMFGKLKETVIWKFEGELENVPNNVHLLKWAPQQSILAHSNLKFFITHGGQLSTTEAIHFGVPVIGLPMLGDQYVNMRAVQNKGFGIMVQLREELADDLNMAIDKMLKDPTYTTTAKHLSSIYHDRPVSPGTEIVHWTEHVVKTGGAPHLRSSALLVPLYQKLYLDYFALII

SEQ ID NO: 6996 - protein, 500 aa, Danio rerio
MRLVVCFLSLLTVFSAGQCGNILVWYTEGSHWINLKIVLDTLLDRGHNVTVLMPDGALFMKAKESDRFSYQHFSVSTSAQDMQDFLDEFLHFSVFELENSNLLQIQMKFFDLLSKHQDMSLSYCDGILKSPELMDKLKKGKFDVLLSDPMYPCSDIVAEELNVPLVYTFRFSLAHTMERMCGQIPAPPSHVPGATSKLTGKMSFTERIYRRPTSYCEMMGRADIWLIRTYWDFEFPRPFVPNFKYIGGLHCTPAKPLPKDMEEFVQSSGDDGIVVFTLGSMIDKVPKEMSNRIASALAQIPQKVLWRYGGEKPDTLGENTRIYKWMPQNDLLGHPKTRAFITHGGTNGIYEAIYHGVPMVGIPLFGDQPDNMVHMTTRGAAVVVDSIKSMQPQELVDKLNTVINDPSYKENAMRLSRIHHDRPMKPLDESVFWIEFVMRNKGAKHLRVEAHNLTWYQYHCLDVFAFLTTVLTLVLYICFKMAKFFIMRCCFRSKRKSKKE

SEQ ID NO: 6997 - protein, 525 aa, Haemonchus contortus
  MOD_RES (41)..(45): Any amino acid
MEYCLQNGSFCPGHCKQSGNFQYSSSRDVGKGGSRCHDGDXXXXXRMSYIGLLLLIFLVPPWSTAFKMVLFVPDIANSQVIFNTRVAETLAKAGHDVTMVMISGYDDRDSSDVKIMKDIHIHRVNASFGMKRKELEEQQQKVIFKDLPMWDSRLRNQISRMTILLTKMCRKVVENKEFLNWLVAQKFDLAFSHIYDVCHIGLIHYAKIPSWIWLNSGGLMDFVAYHLGVPTVPSYVPPIIMESTDEMDFVQRMKSFIGHTIMPGMWKKMISDPETEIFRELVDPNFPDIVDIAKTCPLVMVNSNELYELTRPSLAKVINIGGVGIQMKDAKPLSKEFQKIVDNCEGLVVFSFGSVTPSHRMPDEWKKAFLEAFSRFPKLNFVLRYEGTDLNDQLPKNVFLFKWLPQADLLRHPKTVAFISHGGYNSLQEVITAGVPLITVALFGDQPRNAKLAERHRFAINIRKGDLSADTVAEALQRLLTDKSYSQNVKRLSEMVKKKPVSPDHLLVAWAEFVAEFKTLENLVP

SEQ ID NO: 6998 - protein, 515 aa, Acyrthosiphon pisum
MSTLFRTIILPVFCILTVSMTCYVSIDALQILAIESVAGKSHWNFMSAVLRSLTDAGHNVTVFTPFLDGNRENYTEVYLNVPSVVEINIEETLNTFGKPTTMIPTLMNMSRYFCNIAYEQRDMREILYGGKSNYDIIFTEVVSSECVSYIASKLELPLIYLIPSPMITHIEHTILGDVSNPATVSHLMAHNAVPRTFAQRFLNVVFLGYSLFALKYKEMEMKKIDSQPYDLVEPLKPTLVFMNTHYITYAPSSMPASLIQVGGIHLKKPKSIRNDVLEFIENSPHGVIYFTFGSVVSMSTLPDHIQNAFKEALAQVPQRVLWKYEGEMKDKPINVMTSKWFPQRDILMHPNVKLFISHGGIFGVYEAVDAGVPVLGFPLFYDQPKNIDNLVEAGMGISMDLLTLQKDELIKNILELINNEKYMQNAKIVSDRFKDRPMSPAESVVYWTEYVIRHKGAPHLKSHAFNLTWYQYFLLDVIFVILFFISFTIFINYKLFKLIYYCFLKYSQPMKPKLE

SEQ ID NO: 6999 - protein, 313 aa, Caenorhabditis briggsae
MTDFKSASPCLLYSDVSLYDTSFQIYSGPVASSYSEASGKLLGVDGATKSRIFEESILTVNDFPDTFSFIQPRGSDLIRVGEHCASSRNLPSEFRNFAEDPISKGTIYVAFGSYVNLEDGPEGTVEAFIEALNFFEDYRVIWSHKGNVTGVKCHVKLVNWAPQKEILAHENTVAFITHGGLKSAKEGVCSSVPMLFLPFYGDQPRNAHRFVTNGIAEALYKKSITAIDIKQKLEKLLEDESYRANVAKVRSYYLDAPMSSLDLGAFHISRVLRHPESHFVRFKRRSISMNHLQYLNIDIFLIILIVSFLIFKA

SEQ ID NO: 7000 - protein, 533 aa, Pelodiscus sinensis
MVSLFQGVHHLPIWLLLFMSFWSLSEEGKLLVIPVDGSHWLSMHSLVLQLQQRGHHIVVAAPEVSALIEPSEHYTLKTYFVPYTKEYLEAEFRRLGHQVFTPRPFLERVTQTFARIGNITTFLLNSCKQLLSNKELIISLKESAFDAVLMDPIFLCGQAVAEYLSLPSIYFSRGIPCGLEFQAARCPNPPSYIPRFFTHYTDHMTFPQRMWNIIVSSALSWSCSLLYSSHEDLIRDFLQQDVTMTELLSHASIWLLKYDFAFEYPRPVMPNIVLIGGVTCGQQKPLSQEFESIVNASGEHGFVVFSLGSMVSEIPMKKAQQFAEAFGTIPQTILWRYTGQPPPNLANNTKLIKWLPQNDLLAHPKARAFITHGGSHGIYEGICNGVPMVLMPLFGDQMDNAKRIESRGAGVTLNVLDMTSKDLSAALNTVIYDKSYKENIMRLSALHLDRPIHPLDLAVHWIEFVMRHKGAPHLRPAAHDLNWIQYHSLDVIAFLLAVVLVAMFISWKCCLFCCRKCFCKKGRVSKSSKTKAQ

SEQ ID NO: 7001 - protein, 434 aa, Toxocara canis
MSTATPFRFLLIFVISIIIQLTYAANILFINMYNSKSHALSMMPLAKSLANRGNRVAMFSIMVNSMNELDGGVENIEARMPIEKVQQSLTILGSVVWEWDFQPYRLSRAYTQAEFYYISLDDLDEDWQSFMSRLKTVRDLIIEWFSMGVLGAKTLQNGIRMIGVDEQLSDLVAPVQHFNYKCVAILPADLRRKKPVRSEGAEDFPIVDAKPLPEDVEKFVSSPNSRGTIYVAFGSMADWSNAPSHVIKSFVEAFNALDAYRIIWSSKAKPPEGLKDHIKILSWAPQSSILLHKRTKLFFTHAGLKSIRESICAKVPMLAIPFFADQAKNAYLCRAAGFARIIHKRKVNASVLLESIEDMLNNGSYQRRISKVNKLCMESILAPLRKETFWVERILRSKAPYVTYPIKGAQMPLMQYFGLDIASFLVVIIIVLLK

SEQ ID NO: 7002 - protein, 514 aa, Pieris rapae
MYTLTFFVLSYVLTVANTAKILAVFPTPSVSHQVVFRPLMQELSKRGHDLTIITTDPIYSAANSPKNFKEIDIRDISYKVMRENFTFNVKLGKKSDSFAQIESFVLMNTMLASVQLRHPRIQDLINGQEKFDLIFVEAWQTHAYYYSYVFKAPVILISSYGMFGNEDTAIGALTHPFLFPTLVQQRTFNLTFWEKAEEIYKNLFFRRQWSLMEIEDRNLWRQILGKNVPDFKEIYNNIDMMFMNIHPMWISNQPLPPNVISIWGIYKNQRKALPTDLQNYLDSSKNGVIYLSFGSNVLSSVLPADRIEIFMRVFARLNYDILWKWEKPELPGKSENIKISKWLPQTDLLRHPNVKLFITQGGLQSTDEAINAGVPTIGVPMLGDQWFNTDKYVYYKIGMKLDMETLTEEVLETAIHTVINDTSYRENTVKLRTLLEDQPQSALDRAVWWTEYVLRHGGAKHLRAANANMSWVEFYEVEFVLKFASLLLLPLVLVVAVLYFTYITLMPKQKLKTN

SEQ ID NO: 7003 - protein, 554 aa, Marmota marmota
MAGSPGGQGSQRLHCCPFASPGRSVLLPTVQRVSAGLFFIALWGTVVGDRLLVVPQDGSHWLSMKDIVERLSDRGHDIVVVVPEINLLLKESTHYRRRVYPVPYGQQEMEGRYRSFGNQHFAERSFLTAAQTEYRNNMVVIDMYFLNCQSLLQDSGTLSFLKGSKFDALFTDPALPCGVILAEYLGLPSVYLFRGFPCSLEHALGGSPNPVSYIPRCYTQFSAHMTFPQRVANFLVNFLESYLFHCLYSKYEELASGLLGREMRLSALYQKDPVWLLRYDFVLEFPRPAMPNMVFIGGTNCKKHGVLSQEFEAYVNASGEHGIVVFSLGSMVSEIPEKKAMEIADALGRIPQTVLWRYTGTPPSNLAKNTKLVKWLPQNDLLGHPKTRAFITHAGSHGVYEGICNGVPMVMMPLFGDQMDNAKRMETRGAGVTLNVLEMTSDDLANALKAVINDKSYKENIMRLSRLHKDRPIEPLDLAVFWVEFVMRHKGAPHLRPAAHDLTWYQYHSLDVIGFLLAIVLGVAFIAFKCCAYGCRKCFGKKGSVKKGHKSKAH

SEQ ID NO: 7004 - protein, 400 aa, Vigna angularis
MACSPSLHITMLPWFAQEHITPFLQLSNSLAERGHKISFFIPKHTHASFQHFNHHPNLISLIPICVPQNHHHGLPHVAEEIASKVHSSTVSLSMTPMLLCEKDIEVHLLELKPNIVFFDHAYWVPKPRLTQCLKIKSLVYHVISFSSLTCESSYSYPLGISKGYCCNIAEHHNPLHEPKLLAGSGKVDHGKCIVHTEPCTNSILAQSYATGLKGCTVIEGAYADCHRRHVTVPKEATCLIDENWAKWLGNYEAGSVVYCSFGSECTLEPCQFQEVVLGLELSGMPFVAALRPPKGFECVESALPKGFKERLQGRGVVSSAYFPHRFILEHPSVGCFVTLSGHSGSLSGALVNKCQLFLLPNHGEMVFSAGVIGTTLKVGVEVEKLTTKRVSLLKRVFAKL

SEQ ID NO: 7005 - protein, 529 aa, Cyprinodon variegatus
MELRLSVCVLLLLCASRCSNGGKILVWYTEASHWINMKPILETLVDRGHQVTVLVPSASMFMNSSEPSRFQYEPFDVSISLEAMEESLEEFIHFAMYEADYMSYFQVYVRYMELMRIELQNNLDILSGVVKSEMLLKKLKRENFDLLFADPIYPGSELTADMLGIPLVYSLRFSLAHNWERMCGQLPSPPSFVPGAMSKLTDKMDFSERLWNVLFYALNDIVIDNVMWNMLDKYYSDVKGSPTSACELMGKADIWLMRTYWDFDFPRPILPNFKFVGGIHCRPAKPLPTDMEKFVQSSGDDGIVVFTLGSMITNVTMEKANLIASALAQIPQKVLWRYNGDKPKTLGSNTRIFSWIPQNDLLGHPKTKAFITHGGTNGIYEAIYHGVPMVGIPIFGDQPDNMVHMEAKGAAVIQNMNFMTTESLRDAILTVINDKSYKENMMRLSRIHHDRPMSPLDEAVFWIEFTMRNKGAKHLRVQAHELTWYQYHSLDVLTFFLILDILFIFILLKTCSFCWHRCCKSKKVKRKAE

SEQ ID NO: 7006 - protein, 511 aa, Amyelois transitella
MMRAILLLLSTLSVVYGYKILCVFPVPSPSHNTLGKGIVTALLKGGHQVTWVTPYPFKNENKNLTIIPSRTEMLGKDHNMADPKYAKSGISFVKQFGRNISHATIENELFRKVLINEQFDAVCTEWFFNKLFAGFAAIQQVPWILLNSVTYNAFMEEIVDEVRSLSTIPLLINDAPVPMNLLQRLKNTWIYTMVAVSEWLDSFSAQEEFETYFAPLAAARGVPLPLFSEIEKNVSVLFVNSHPSFDVPFPMPPNVVPIAGYHIPEYVPPLPNDLQSILDNSPNGVVYFSLGSVIQTSNLPEHTLKDLIRILGELPYTVLWKFEKEFTGLPKNVHIRPWMPQPSILAHPNVKLFITHGGMLSSLESLQFGVPLLAVPVFGDQPSNAARATNAGYAKTVPFSHDMGPKLQAVLNEMLSDDKYYKRAKYLSALFHNRDVAPSKLISHYVEVAIESKGAYHLRSPTRLYAWYKRWMLDQLAILLAVVYLLVVIVKKLFSLGSSSKEKSHIKKKRN

SEQ ID NO: 7007 - protein, 520 aa, Myzus persicae
MTAVVVEPTGRLAVGLQAAMVVVMVLLLEWPSAASGARILAVFPYNGHSHFAMVEPLMVALSERGHHITVISPFPRRKGSGGGRRYVDVDVSDTLPPVISQLNVTKEFGHLVDPVTGFRHLCQMNHRVCEATFEHPLVRALIHEPLRFDVVFAEAFATDCFAAFAHAYDAPLISIRTSDYSPQLNRRVANPQNPAYLVNHLLTYTSRGMSFAQRLVNALATHFGVVGYHAFSDGPSTELVRRHFGPGTPPVPEIARRRTALVLVNAHHSLTQPRPTVPNAVEVGGLHIAQPAEIENEWSDYCDLCDQGVIYVSFGSLLKGSSFPLQFTMAFVRAFEALPYCVLWKYEGEMISKRIKVSKWMPQQQILGHKNVKVFITHGGLMGVMEAVYFAVPMIGIPVFGDQQSNVANCVAKGIAIGLNHRQITVEKLIKSIQAVVMDSKYKSKAFELSARFRDRPSSALETAVFWTEYVIRHGNETNTASLAIDFDFYQYFLLDVVLVGLSILLFLFYTAFRIKKCIR

SEQ ID NO: 7008 - protein, 528 aa, Drosophila ananassae
MKRKNLNIGFISLFCFYFVATVSAYNYLVVSPSAASSHYHVGFSLVKGLANSGHNVTLISAFKQKKPVDNIKDVTALGIHKTMEEHISSIVKNMKKPMWLQSFDIYSMGLKMTEALLNDTSVLELMKSNKTFDAVISEVFLNEAQLGLAEHFKAPLIVLSAVGAMPAHADLVGTSFTPSYIPHALLHFTDHMDLWERLVNFLFVTFTYSIHKFFALPQHEALYQKYFPDNKMDFYEMRRNTALVLVNEHASLNHPRPFSPNMIPVGGMHINRQPPQPLPENIRLFIEGAEHGVIYCSLGSNVKSKTLPLEKRRAFLETFGKLKQRVLWKFEESDLPGRPDNVLISDWFPQNDILAHDKVIAFISHGGRLSILESIYHGKPFVGIPFFGDQFMIMAQAEQNGIGIALNYGDLTADILLAATKKILQDPKFTRNVRDMSDRFRDQPQTPLERAVWWVEHVTRHKGAKYLKSAGQELNFFQYHSLDVLLILFIGLFFIIYLPIKTFVWILNRLNQFFFKTKVQHGKKIKQN

SEQ ID NO: 7009 - protein, 657 aa, Papilio xuthus
MEPGLPSGLPCVTYRPFLGVKMKTTVLLWMFLTISSISAYKILCILPAPSRSHATLGRGIVNTLLEAGHQVTWATAYLDKSNNKNLRQIEISKSRDVVEGMDVTNQGRMSVSLVREFARNISIAALETSELRDVLINEKFDAVVTEWFFSDVEAGYAAVQQVPWILLSGVVMHPYLEYLVDSVRSLPVTPFMMNDFPVPMDLWDRLANTYSFGMFMFGNWLESTTSEGDYDKHFSSIAKARGVSLPPLSLARHNISILLVNSHSSFAPAQPLPPNVIEIAGYHIEETTPTLPKENIMMLHISVKICVKSNRTWPVVDYGLVILNLGKATSHSVETYPERLHESRLESTTSEGDYEKHFSSIAKARGVSLPPLSLARHNISILLVNSHSSFAPAQPLPPNVIEIAGYHIEETTPTLPKDLQDLLDSSRNGVVYFSMGSVIKSAALPDSTKRELLRVLGSIPYTVLWKFEEQLEGLPKNVHIRSWMPQASILAHPNVKLFITHGGLLSTLESLRYGVPLLAIPVFGDQPGNAIRAMRSGYARKVNFSPDMAPELEKELKHMLSDDTYYNKAKELSMLFNSRPVTQRKLILHYVELAIESKGAYHLRSKSQLYKWYELWMLDQLAVVFAALFLLYLLLKKIVSVLTKKNVKEVKKSKKNK

SEQ ID NO: 7010 - protein, 305 aa, Ancylostoma duodenale
MRPGFLPKLFMGHEYAICRKYPYVKVMANTNDLYDMTRPLLAKVVNIGGVGMELADAKPLPKNFDAIMSKADGAVLFSFGSVTAAHKMPIEWKKAFLESFRNLPKYQFLMRYEKDDLNDKLPPNVHLFKWLPQSDILRHPKTKAFITHGGYNSVQEAILTGTPLIAIPLFGDQPKNARLIERHGIGMILQKGEISVHTITKALAKVTGNSRYSANAKRLSRMVDRKPVSPSHLLVKWSEFVAEFQTLENLEPAGNKLNFFQYHSLDVIALLISITAIVLFILFQVVKFACLRIFSYCKQKKQKAE

SEQ ID NO: 7011 - protein, 525 aa, Drosophila ananassae
MIFLHLKIDFQLDVAEAADILGIFPYLHTAGPLFVRPLVRVLVERGHKVTVISPEHTPTDIEGVRHIRVPELNRQIRKIMDPDHYFHFFSTKWKKSILAATMLANVSTALLADEGVRKMMKDRSERFDMVMIEASHLEAMYGLAEYYNATLMGIASMRLNWHVDELAGNPSPSIHESISLEGPPLKYSLLGRFYNWLDITEEYLLERLVIRPSQLKIFKWFFGYSAEKLEELRSRFNLILINTHFSMGRVRANVPNIIEVGGMHLSDPPEPCDEELQRFLDEAEHGVIYFSMGLEIRFKYLPDYMQQPLLQSFAELKQRVVWKNELFTSPNKTDNVFRIGKAPQRIILSHPNTRLFITHGGLLSVIEAIDSGVPMLGLPLFFDQFNNMQRVESAGVAKVLDWNSLSVDNLISTVHEIIEDPKYAQKARETAQNFRDRPMNPLDTAVWWTEYALRHRNATHIRLNKGELPFMVYYQLDNLLPLILRIGVILVSIIFFSYKLFEKLQIRQRRLQERNLFLRQQIMLR

SEQ ID NO: 7012 - protein, 513 aa, Bicyclus anynana
MNNLLKILCIVSLIGSMESARILAVYPVPSISHQVVFRPLMHELAKRGHEVVVITTDPAYPKSSPQNLTEIDVHDLSYKMWNDFLASGKAQSHMTAEQLKIFMDVILDVFEAQTKSEEVQKLINDKEKRFDLLFVEACVRPALAYGYRYKVPMIEFSSFGGIVGTYDETGASTNYLLYPTPLREKVYNLTFWEKLHDGYQEHTNNKIAIEHEAIENEVVRSIFGPNTPSLSELKKNVHLIFLNVNPIWDFNRPVPPNIIYLGGIHQKPDKELPKDIKTYLDSSKNGVIYMSFGTNARPSLLPVETLNIFTKVFSQLPYDILWKWDTEELPNRSKNVKISKWLPQSDLLKHPKVKLFITQGGLQSTDEALTAGVPLIVIPILGDQWFNAEQYVKFNIGIRLSLETINEADFKNAIETIIQDKTYRENVVKLRNIMRDQPQTPLERAVWWTEYVLRHGGATHLRAAGAHMHWTEYYAMDVVVFIFTVALVIVGSAIFAIRYAMSLKGLKIKIKKS

SEQ ID NO: 7013 - protein, 517 aa, Neodiprion lecontei
METRAILVFLAACYVTNGARIIGVFPYQGRSHNIMFEPLMIGLARAGHTIDMISHFPPAKPVPGYNHINLKGSLPTYVNNVTASHARKATTVGYGISRLCGLLSKQLCSLFETPQVQNILNTDVKYDLMVTEVFTTNCFLAVAYKLKIPVVGVGSSVMYSWGYDPFYGEANPSFIPSQFGAFTNEMSFIQRVENTIVHFYSKYLFYSYEKTVSEPVAKKHVPDLPSLNEIYNNMSLLLVNSHYSVHGARPGNPAIVEVAGLHIDETQALSKELDVFLNSSKDGVIYFSMGTMVRSDTFDPEKISAIYESFSELSNYKVLWKGNVEDLPKPLPSNVKVVAWAPQYAVLRHPKVKAFVTHGGLMGTIEAIQAGVPMVGMPFMVDQTFNIMGYVQKGIAVHVNYEDLTKASFSNALREVLLNPKYQSNSERIARLFKDRSLSPLDEAIFWIEYVIRNGGEPLKSSGRHLNWFQYYLLDVFLFLINIAAIVLAIVYVIVKKTLSAIVGTKSHATSSKKKIS

SEQ ID NO: 7014 - protein, 1042 aa, Caenorhabditis brenneri
MHRLQKDNHTTALEFAMFHPDIDFGMEEQFIEMGGFQNPFASPDFDKIAFDEEYSFIHQAVAYGFGSETCNNILSHRRDRFFEILNEGWDLYMSDSLFAVCGYGMAEISGKPHVMMHSTDLEAAQGSFKAFSRNYATFVPSNLPFTMLDFTVSKFQHRVWATYDWFGSFIFTAFVGNFAQKWALRSIIPSPYFSFSEYNRRSSFSFTDMPDSLFPPASRTNDFFSFGAYCKSSHKPLDAEFKTFIEDPKSKGTILIAFGTFIDWRKAPDHYYEAFSTVVNQLTDYRVIWSMKGDRPSGLGKHVKTAAWVPQNQILHHNKTVLFLSHGGLKSTKEAICSATPTIFVPMFGEQTRNAWLIQEKGFGRIMNKFKIDEDVLGTHVNEVLLHPDYQNNANKFLTHYMDQPIPTLDEGAFKFNRLIKYGGKMPSPVTSLFLNPERRHIRINEFKDEFMESFRVFSPAVFETVDLLAEGQMINEVNELLGDYFRFYSQGNRRASFVEISPNLLELGRRNLEVDARNMEALADHQLQQLREIYHNKNVLPSPPPPEPDFLDYASEFRLNQTAVNTGPEKRTGGVPKSRVKRSPPRQYREPYSGGPSRHQNQPSYPRSPGRSPSTSNRRYQTSQQEGSSQFSSSVSSRGGYSGGFSNMRYSKDPRSMGNAGQMHPREAAPRFSSFRYDEPGTSYSSSDPQDDSGPLFQPGRQHRPHESSSEYGRHRSTSIHRHRFNEPHASREAQFRFPHQVSSDNRYRETDRRESWSESAGRSRLESREESSFSRTPASSRRPSSDEQSSVYFSAPSEFESSEDRVKSSAYKSDFNRKDETSQRRLKTGSSHISANSRDSDEFSSMDEAFAQEKDSDRRSDYKNSSSRRFQDTPVWIKESKNRISTSSEFDVDEERSFRHARKTRDFSTSSSGASQASMLSFNPNASPFIPHTAPPSQSTTSSLFSERSYSNNVAASRHDRPNRNSAESTAVSNRPEERKIVECVRCEPMMCNSNFLIRCWNCKRVQCPPNHYIPPEFQERAKLTCFHCHAPLDKSNYPL

SEQ ID NO: 7015 - protein, 513 aa, Acyrthosiphon pisum
MYLKLFSILFYTFAGSWIPAPVESANILAVETVGCKSHWNFMSSILRALVDNGHNVTVFTPFADGNRENYTEVSTGATTFLEMNIEDLMDKSNGPIKFTSHMLQMSRTMCNVIYENSKMKEVLSNTRSDFDIVITEPSRSECVSYLAIKLNLPLIYLQPVPTMGIMERMYTGHMSNPAVVANKLASFGVPKTFVQRTSNLAILISCTIIREFNELIMKFTEPKEYDLHAPIPPSLVFINSHFTIEPASPIPSNVVAIGGIHLNLKATKKLPKDILDFIEQSPHGVVYFTFGSIVKMTSLPEHIKKALIDGLAQIPQRVLWKYEDEIENLPKNVMVRKWLPQREILLHPNVKLFISHGGISGLYEAIDGSVPILGFPLFADQPKNIDNLVNAGIAISMDILSITKDAFLKNVLELLNNEKYMENVKTASKIFKDRPMSPASLVVYWTEYVLRHKGAPHLTSHAMNLLWYQYYLLDVIALILVFIIVVIIVSYRIFKSISKYFSKYSRNTKSKSE

SEQ ID NO: 7016 - protein, 265 aa, Mustela putorius
MPNMVFVGGINCAGKNPLSEEFEAYVNASGEHGIVVFSLGSMVSEIPEKKAMEIADALGKIPQTVLWRYTGTPPPNLAKNTILVKWLPQNDLLGHPKTRAFITHSGSHGIYEGICNGVPMVMLPLFGDQMDNAKRMETRGAGVTLNVLEMTSEDLANALKTVISDKSYKENIMRLSRLHKDRPIEPLDLAVFWVEFVMRHKGAPHLRPAAHDLTWYQYHSLDVIGFLLAIVLGVVFIAYKCCAWGCRKCFGKKGRVKKSHKSKAH

SEQ ID NO: 7017 - protein, 520 aa, Lissorhoptrus oryzophilus
MFSICLYMREIHFLILCTLFFTTQSAKILSIFMTPTYSHQIFYQPIWRELSLRGHKVTVYTPNPINDNSLTNLTEYDLGFSYDIVKNIHFQDTNSPSDNLKLISKIYESVFEGQMNHKYLQDLIRNANNETYDLFLVEYMWQSYYAFKELYNVPMVGISSLPLTLLASESLGMEKHPVLDPEIFLQFSNANTLGRKILSWAYNWFYKILVKPQLQNKFNQEIRKYFGEGIKDVRDLAKEVSLIIGNYNFVLQNIKPLLPNYIPISSVHIKSRKPLPKDLAQHMDNLKTDAIYFSLGSNIKSSKVFMPKLEELLKILGSLPYTILWKYETDKLPKNLPKNFLVRKWFPQQDILGHPKVKLFITQGGIQSIEEAIVREVPMLIMPFLFDQKVNADRCVELGIAETVNFYEFTEEEMDNKIKKLLNNQMYHKNIKEKAQIIRDQPLNPVDTAVFWIEYVLRHNGAPHLHYKGADLPFYEYYMLDVYAVIGIASYIMLRIFKIVLKVIFLFYYRAKKRILCKII

SEQ ID NO: 7018 - protein, 529 aa, Drosophila grimshawi
MELFRSVLFITLLYQLLAALGVGVQAAQILAVFPFPGKSQYIFAEQYLKELARRGHNVTVINTFGSSQIDPNFKVIGATKIHELMAAFGSADYDQQASQWTILTMTTQFLNMLTTSVLDDAAVQQLLQSEQAFDLVLLETVQTEALFGLAQHFRALTMGISSYGTDRHIDDLMGNISPLSYNPMLLSSRTDHMSYEQRLWNLWDACLSWLHKHWVHLPSQEKLYEQYFPQASKTLEQVLDSFSLMLLGQHFTLSYPRPYLPSMIEVGGLHLQQERDPQPLPDDLATFVTGASHGVIYFSMGSNIKSSDFPAPTRQVLLQVFGSLKQRILWKFELEQLDDLPENVLISKWFPQPDILAHPNVKLFITHGGLLSTIESIYFGKPVLGLPVFYDQHLNVERAKQAGYGLVLNLWSMNATQLHDHIMELLSNISYTQAAKIKSKLYRDQKDTPLERAIWWTEYVLRHKGAPHLRSASRDLNLLQLHSLDTWGLLGGIVSLLVLVILFVLLRVLRILRYILCRRWKTNNKLKTQ

SEQ ID NO: 7019 - protein, 514 aa, Drosophila busckii
MNLRWFILLWAWQSVQAANILAVFPFPGRSQYIFAEQYLKTLASSGHQVTVINTFGSNETLSNFKVIGATKIHEILAAYGNADYSQTASQWTVASLTTDFINLLTSCILEDAAVAQLLRSQQTYDLVILETVQCEALFGLAQHFNALTIGISSYGTDRHIDELMGNISPLSCNPLLLSARSARMNFAQRVANVWEAAVGWLHRQWVHLPSQRRLYSQYFPAARRSFEQQLGSFSLMLLGQHHTLSYARAYLPNMIEVGGMHLRQSKPLPAQLAEFIAQADAGVIYFSMGSNIKSADLPPATLQLLLQTFGQLQQRVLWKFEAEHLSNKPDNVLIDKWFPQTDILAHANVKLFITHGGLLSCIESIYYGKPLLGLPVFYDQHANVQRAQDAGYGLGLELWTLNGTQLQQTINELITNSSYRRAAELRSQLYRDQLETPLQRAIWWTEYVLRHKGAAHLAAPARDLNLVQLHSLDSWGLICGAASLIALIILISLIALLKCLSYLRTKTAAKAKTQ

SEQ ID NO: 7020 - protein, 1037 aa, Diachasma alloeum
MSFIRLLSLIASILIIHNETVSALRVLAIYPFAGKSHSIGAEHLLKEMTRRGHSVDVVSHFPQKEPIPNYRDISLRGSLPIFANNVTYDMITEYSIMQPREFVELAGISVCELLGLPVLQELMEKPKGTYDVIIVHLFAAHCYIGFGQKLNAPVVGVVTSRLQDWLFDPFANPLNPSYIPSFFSTFTQHMTFWERLQNTLITDSTRHQFRYWLEAESLQVEKYFGRRISSLYELYKDVSLVLVNEHFSSNDIKPATPDIIDVGGLHIYDNTQQLTPELQDWLDGSTEGCVSFTFGSNVIIESFPKELLKAFYQSFKRIAPVRVLMKGDPKALVKDLPKNVKILPWIPQIAVLKHKNVKAFITHGGLLGTQEAIAHKVPMIGIPLFGDQYTNMQNYANRGIAVVLDVKTLNENSLTNAINTVLKDPTYRKNIAKMSALFWDRPMSPVDTAIYWIEYAATHGPVLKSPATELSWWKFYSLDVYGFMLMCILTIIYTIIKLITLLCRCSRTQRKKHRDKMSLIKLLPLFASLLIIQNENASALRVLGIFPFPGRSHTIDVEHLLKEMSRRGHTVDLISHFPQKKALPNYRDISLRGSLPMIANNVTFGKFKTFNSIGLERFIKVTGTDVCDLLDLPVLQKLMETPKGTYDVIIVELFVSHCYIGFGQKLKAPVVGFVTTKLADWLFAPFAIPLNPSYMPSMHSGLNQRMTFWERLQNTLLIDSICIQFDHYLKAQVPQVEKYFGRRISSIDELYNDVSLVLVNEYFSTNDIKPATPDIIDVGGLHIYDDPQQLTPEVQDWLDESTEGCVYFTFGSTVNLESFPKELLNPFYQSFERIAPVRVLMRGDPKFHLKDLPKNVKILPWIPQIAVLKHKKVKAFITHGGLLGTQEAIAHKVPMIGIPLFADQHNNMRNYENRGIAVVLDLKTLNENSLTNAINTVLKDPTYRKNIAKISALFWDRPMSPVDTAIYWIEYAARHGPVLKSPATELSWWKLNLLDVYGFMLMCVLAIIYTIIKLITLLCRCASGTHSKNVSKAKKHR

SEQ ID NO: 7021 - protein, 519 aa, Heliothis virescens
MKILVLFSLFFGLCSVESLKVLVCFHMPVKSLSILGTGVVRHLLNAGHEVTYITVYPLKNPPTKNFRQIDISKNIELVAHDETLTMGYVLEHQIEKNGAYQIQVFAEENARLTFNNENMKKLIQDPNEKFDVVVCDLLESEVYAGLAVLYECPMVWLYSMGAHWQVLRLIDHGTNPAFTPDYLSPNNLPLSFSERVEELWARVRWQFLKTFITQPRERKMYEEIFGPLVARRGRTLPDYEDVIYNASLIFGNEHNAIRDRPATPQNFKYIGGFHIEDPVKPLPKHLQELMDNSKHSVIYFSMGSFLQSTSLPRKLVVELLNMFGELKQTVIWKYETNLTDIPKNVHIVNWAPQPSILAHPNLKMFITHGGLLSSLEAVHFGVPIIGVPVFFDQFTNINKAVVNGFALRVNLDYDLPNGLRSAIKVMLNDNRYSQKVKEMSSIYHDRLAKPGDEIVHWVEHVVRTRGSHHLRSPAFYVPLYQRLYLDLLALILAAIYVIKQLLASFYETKSKKNSKKKRN

SEQ ID NO: 7022 - protein, 514 aa, Amyelois transitella
MLKLFLLIFSYCILQNESARILAVFPTPSISHQVTFRPLTQELVRRGHDVVVITPDPAFLNSDKPDNLTEIDVHDVSYKLWTEKVTNEAVAFGDKGGLVKQLDVIFDTIVQVFETQMASDEVQKIIKNETGRFDLLLVEAFVLPTLGFSHIFKVPVIQISSFLPLYFDLHNVGAPDHPILYPTFGSQKLDNLSIVERIEALLGYLYLDMDKYETVLDDVNKRVFGPNVPRLKELYNNIDMLFLNTFPMWDSNRPVPPNVKYVGGIHINTLKELPQDFKAYLDSSTHGVIYISFGTNVSPSSLPPEKIQVITNVLSRLPYDVIWKWDKEELPGRPKNVKIMKWVPQSDLLRHPKIKLFVTQGGLQSTDEAISAGVPLLGIPMLADQWYNVAMYERHRIGIKVDLDEVSEEKFKDAIDSLTKDDTYKQNIMRFRSILSDQPQTPLQRAVWWTEYTLRHGGAKHLRAPAANMPWTTYYQLDVLVVVMLAAMPVIYLMVMMISAVKMLYNAMMELANK

SEQ ID NO: 7023 - protein, 245 aa, Diuraphis noxia
  MOD_RES (58)..(58): Any amino acid
MDKIDILDFIENSPHGVIYFTFGSVISMSTLPDHIQNAFKEVLAQVPQRVLWKYEGEXKDKPINVMTSKWFPQRDILMHPNVKLFISHGGISGVYEAVDASVPVLGFPLFYDQPRNVDNLVEAGMGISMDLLTLQKDELLKHILELINNEKYMKNAKIASDRFKDRPMSPAESVVYWTEYVIRHKGAPHLKSHSLNLTWYQYLLLDVIFVILIVITFVIFITYKLLKMIYYYFSKYPQITKPKLE

SEQ ID NO: 7024 - protein, 526 aa, Anopheles darlingi
MEKRFCQWLVVMAVLCIWAEYAVPGVKSAKILSIFPTTSKSHWILGSALMKELAHDGHEVTVISPFPLKNAPKTYRHVEITYNSSLFDDIMDEVFERVDDNFFQKMKEIVSFIEEIVNSTLTSPAVQTLLNSDETFDLLVMEVFLDDVFLGFADRFNCPVVGMSTFGASTWVNALTGSPQPLSYVPHPMTAFTDRMNFWERLGNVLFTAFDEVLMASAGIPVQQRYYDKFFPNANRSLSEMRRHGVSLILVNSHFSLSFPRPYLPNLIEVGGFHVNRKVNPLPEDIQTFIEQSKHGVIYFSLGSNLKPSKMDLQKRNDVIRVLSSLKQNIIWKWDDDTLVLDRTKFLLGKWFPQDDILAHPNVKLFITHGGLLSCTESIYHGVPIVGIPIFGDQLLNMARAEVSGWGVGVAYTKLNEATFAKAVTEVLNDENYAKRIAVISRRLRDQPVAPMDLAKFWVEYVLRHDGATHLISSAQDLSFIEYNNLDVYGFILTIAGLIVLLITLGCKKVTQRILPKKSNKSKKNN

SEQ ID NO: 7025 - protein, 531 aa, Cavia porcellus
MADPLPAFQRVSTGLFFLSLWGIVVGDKLLAVPLDGSHWLSMKDILEHLSGRGHEIVVLAPEINLLLKESKYYTRKLYPVSYSQEELEDRFRSFGNHHFAERTYVTAALTEYRNNMIVIDMWFFNCQSLLKDSNTLNFLRESKFDALFTDPGLPCGVILAEYLQLPTVYLFRGFPCSLEHAAQCPSPSSYIPHFFTTYSDHMSFPQRVKNMLHILGWKFICHFIFTPYASIASELFQRDLSVVDILSHASVWLFRADFVLEYPRPIMPNMVFIGGINCISRKPLSQEFEAYVNASGEHGVVVFSLGSMVSEIPEKKAMAIAEGLGKIPQTVLWRYTGTPPSNLAKNTILVKWLPQNDLLGHPKTRAFITHAGSHGVYEGICNGVPMVMMPLFGDQMDNAKRMETRGAGVTLNVLEMTSDDIADALKKVIYDKSYKDNIMRLSSLHKDRPIEPLDLAVFWVEFVMRHKGAPHLRPAAHDLTWYQYHSLDVIGFLLGIVLLVAFISFKCCAYGFRKCFGKKEQRKKTQKSKTH

SEQ ID NO: 7026 - protein, 545 aa, Diuraphis noxia
  MOD_RES (349)..(349): Any amino acid
MRTFALSTAFCNTMQLLVLLTLLLLFAEKSSSDEHKLQQVKPLNILAFLPTEGKSHFMGFKPLLETLVSRGHNVTLVAPFALDGAKRPYRHVKVEQTLGDFDMLKVAKYVNLVPTPLHLWWFGPHISETSLDKPSVANFIRTDRSSFDLVLFENFYHECFVTIGHKYNAPVVQLLPFSANSRISQWHSNPYNPAYIPDLTSAFGSNMTFAQRTTNAISAFFYTAVSRLVYLPRQRAVADKHFVYPGHERRPDLIDMLRNVSLTLVNSHPVIGSAVPMVPSFVYVAGMHCVPAGPLPEDLKQIMESAKEGIVYFSLGSVVKSSKMPKETVSLLLSEFSKIEQTVLWKWEXDDIPQLPKNVIVRKWFPQNDILGHKNCKLFITHGGIQSTTESIYHGVPMLAIPVFGDQQGNSLRAQYQGIAIQVPYFELTHEAFGSALHKLLIDPTYRENSKKSSAMFRDNPLPPLQKAVFWVEYVARHNGAKHLRTAANDLYWFQYMLLDVLLLVSFVVVLMAWTTKKMLCYVFSRCCRSRRNITSPTSTEKKTQ

SEQ ID NO: 7027 - protein, 527 aa, Linepithema humile
MKVLLSVLLAILACDQVVNGYRILGVFPLNGKSHWVMMEELMKGLARRGHQVDVVTHFPQKTPIPNMREISLKGSVDAVINNLTAVDIQRFGALSMESLAEIAGMRICKLLGHPKLQDLIENPPQDPPYDLVITELFAAPCYLAFGRHLNVPVIGMVSSVFHDWLNEMAGNPMSPTFVPSLFSTYDQNMNFKERLLNFLLTNYITWQMHYYTNSQLELVKKHFGIDVPHIMDLYSDVSLYLVNSHHSINGIRPMTTGVIEVGGLHLKDDDDPLSPEVQKWLDESKDGCIYFTFGSMVRIETFSKELLKTFYTSFEKIAPTRVLIKIAKKEELPPGLPKNVMTQSWFPQITVLKHKNVRGFLTHGGLMGTLESIYCGVPMVGIPLFGDQRVNIQNYVNKKVAISLESIDDVTEEKLTSALNNILKDPSYRKNIQKLSKMYLDRPSSAMNTSIFWVEYIAKYGNVLKSPVTRLHWWQRNLFDIYAFISLVIIVVLYLALFILRTLKKLVFGSRACAKKDNAAIKSKKNK

SEQ ID NO: 7028 - protein, 520 aa, Chilo suppressalis
MSASTGLILITTLFIYGDDAARILAYYPTPLISHQAVFRHLTLELHKRGHELVVITTDPMFSREEAPANLTEINLHDMSYNAWKTEASMPAAATQGSKESFQKQYAPIYKLLVKLVGMQLSTPEVQALIKDKTKTFDLILLEAYIDSALGLSHVFKAPVIQFSSVGAAVNNLEVIGAPMHPLLFPTLVHSRIYNLTLWEKLTQIKTFIDHVSVMKQTNIYAEEMLKNVIGPDVPPMDELWKNVDMLFLNVFPMWDFNRPLPPNVILLGGIHQKPEKDLPKDLNEFLDASKNGVIYVSFGTNADAALLPPHKLEVMVNVFSKLPYDILWKWNNDELPGRTKNIRISKWLPQADLLKHHKVKLFITQGGMQSTDEAIDAGVPLIGIPLLGDQWFNVEQYLFHKIGLYVDIETITEEKFGNAIEEILHNDSYRRNIRRLKTLIQDQPQTPLERAVWWTEYVIRNGGARHLRSPTATITWAEYLELELVFYILLTIISVSIAILFICCKIYRLLTRNSKKVKKS

SEQ ID NO: 7029 - protein, 880 aa, Solenopsis invicta
MRVLPVIFLWLHYLSVCNGYRLLGIFPLQSKSHFGMFEQLMKGLARKGHQVDIVSSFPLEKSYPNYTDLVTLPTTREVVNKLSYAEMKIFTTNPTYVIGTLGGNEVCKHLGNTKIKELAKQKNPSYDAIIVEVLAAQCFSIIAHILKIPMIGVTTRTLYPWVPQIIGQPENLAFVSNINLDFTTPMNFWQRLCNVLRTLYDKWFFDYLTTRVQDKLIRENFGPDMPSVREIERKLSLILVNSHITLDGIQPRTPAVVDVGGLHIHAENQTCCTQLQPELKKWMDDSKDGFIYFTFGSMVTIETFPHEFLRILYASLGKIAPVRVLIKVTAPEKLPSGLPENIHISPWMPQLMVLNYGIMRVLPLIFHWLSYLSVCDGYRLLGLFLIPRTSHFVMFEQLMKGLARKGHHVDMVSSYPLKKPYPNYTDLVTLPITREVVNKLSYAKMNILFTVNPMYVIGALGGNEVCEHLGNTKIKELAQPKNPSYDAVIMEVHGAQCFSIIAHLLKIPMIGVSTTGTLYSWLPQIIGQPENPAFVSNIILGFTTPMNFWQRLCNVLRTLYDKWFFDYLTTRVQDRLIRENFGPDMPSVRELERKLSLILVNSHITLHGVQPRTPAVVDVGGLHIHAENETLQPELKKWMDDSKDGFIYFTFGSMVTIETFPHEFLRILYASLGKIAPVRVLMKVTAPEKLPSGLPENIHISPWMPQLMVLRHSNIKAFITHGGLMGTQEAISCGVPMIGIPLFLDQFTNINAYVVKNIAIRLDINEITERSMDAALNAILQDPLYRESAQNLSRRFLDRPLNAIDTATYWIEYVIKYGENSLRSPAMDMSWLQLSLVDVIGFLLFCAIIIIAVIVFIVQFTLKLKHKDSNTLYSKKFKAN

SEQ ID NO: 7030 - protein, 521 aa, Trichoplusia ni
MRVFGHILFLYSIFIVNSNEAARILVVVPTASVSHQVVFRPLSQELAKRGHDVTIITTDPAFPKGGAPANLTEIDLHDLTYKGFIDEISKMPKGNKKDMLNNFRIFYKFWPKLFGKQLKDESVQRLIKDKNQKFDLLILEAGVRQALVFSHIFKAPVIQMSSFGVMFDNFQIIGAPTHPLLYPKILRQKLNNLTMYEKLTELYTHYMLEYMHYESRHLEDKILREIVGPDVPSVTELANNVDMLFLNVNPVFVGIRPVPPTVVFTSGLHQIQQKELPKDLKSYLDSSKNGVIYISFGTNMDPAGLPADRLQVLVKAFSQLPYDVLWKWNGDELPGRTANIRISKWLPQSDLLKHPKIKVFVTQGGLQSTDEAITAGVPLIGIPMWGDQWFNVEKYVTHNIGIGFDLDDMTVENFKNALLKIIKNDSYRQNVVRLRTLMHDEVQTPLERAVWWTEYVLRHGGAKHLRSPAANISWWEYLELELVLTLLAGLLVVLFTFGVISYKLFKYFFKPISAPVKLKSS

SEQ ID NO: 7031 - protein, 521 aa, Trichoplusia ni
MSVSAYILLFSFIFIVNINEAARILVVVPMPSISHQVVFRPLTQELAKRGHDVTVITADPAFPKGGAPANLTEIDLHDLSYTLFKQEMKKLPKGNKEDMLQTFILFMQFWPKIFGEQLKDAGVQRLIKDKNQKFDLLILEAGVRQALVFSHIFKAPVIQMSSFGVVYDNFEIIGAPTHPLIYPTVIREKLNNLTMFEKLREVYKYYTMESLYYANRHQEDKLIQDVLGPDVPSVVDLYDNVDMLFLNVHPVFEGIRPVPPTVVFTGGLHQIPPKELPKDLKTYLDSSKNGVIYISFGTNVDPTLLPADRIQVLVKAFSQLPYDVLWKWNGDELPGRTKNIKISKWLPQSDLLKHPNVKVFVTQGGLQSTDEAITAGVPLIGVPMIGDQWFNVEKYVSHKIGVRIDLEDITVESFKTNLLKVIEDDSYRQNIVRLRSLIHDEVQTPLERAVWWTEYVLRHGGAKHLRSPAANISWAEYLELELVLTLLAGLLVGLITFSLIVYKLYKYFITNLWSPVKVKST

SEQ ID NO: 7032 - protein, 519 aa, Papilio polytes
MMRLRISVLYLLCVTLSLIKSARILGVFPTPSISHQVVFRSLTHELARRGHELIVITTDPVHPKGQVPENLTEIDVHDLSYNIWNKGISELEDGSRDVNKQVLAMMGLNFEIFEKQMKSKSVQELLTYKNDYFDLILVEGMLSYTLGFSHIFKAPVILVSSFGGIWDNYVVMGVPTHPILYPSMVRDRLNNITMWEKIMQLKIEYNMRNIDTNNVMVNNLLKKLFGADTPPVTKLYDNVAMLFLNVHPIWDTNRPVPPGVIYMGGLHQNPIKELPKDLKSYLDSSRNGVIYFSLGTNVKPSYMPPEKLKAIVNVLSRLPYDVLWKWDNDELPGRSSNIKLSKWLPQSDLLRHPKIKLFITQGGLQSTDEAITAGVPLIGIPLLADQWYNVEKYVEHKIGVRIDIDTVTEEIFESAIRTVINDTSYRENIMRLRSIMSDQPQSPLERAVWWTEHVLRHGGARHLRSPAANISWSQYLELELVFVLLLVFIVLLIILCTVLKMIFNFLNSNLYAVVKMKRS

SEQ ID NO: 7033 - protein, 1978 aa, Trichuris suis
MVSVCLLTLSLFVESATAELSEWAFVGKEAFEEEVTKFFVTKLAPMKILHVSFSAFDRCPRNQSNPYGVSKVRMKVSCPQEDASGCGLHRTSGDITEVMIVDCQFAAEIVGYAVGRPLAVLCYQNSSSSTEEIPAGGLCKKWRYPGTELPQLQVPEHLKSPHSHVLLYQTTNLESFSGYGSNSHGVNTAHWKQNSYERTGFSGKGKLAQFGANSAVYLHTYGITKVLVEDTDDYTALPQFWVKRGKVDDDLLMRKLLKLNMYCLDEMIKAMVKTKQRLHTGYLRNKHNTDNAWIEGDIVHLHDETGGCFTPYPIHAEVKSRQYRWLALPYFITPIVFARSFSVCGLNRIGEDVTEIMIVECQFAGGAGRLVAALCYQNNMKTCGQSMEELPTPTGVLCKKWRYPGTELPRLEVPEHLKSPHSYILFYNPADMESFYGYRSSKDEFGRPKWPKNPYERTGFAGRGKLPEFGPNQALYILITRHTYGTTKLLIEDTDDYVGLPQFWVKKGKIDGALLMKKLLVLNEYCLDPMIKRMVETQKLYHIGYLKNKHNTDNAWLNGTIIHVLDETGGCFTPYPVHTEVLAGQYRWQVLPYFTTAKEFAQFFLATADRREWPPPTRHEFEDGAKRFFRRKLSPIKILDFIFSGFDTCPFKGKGPYGVGKARLKVSCPYQNASVCGLNRIGEDVTEIMIVECQFAGGAGRLVAALCYQNNMKTCGQSMEELPTPTGVLCKKWRYPGTELPRLEVPEHLKSPHSYILFYNPADMESFYGYRSSKDEFGRPKWPKNPYERTGFAGRGKLPEFGPNQALYILITRHTYGTTKLLIEDTDDYVGLPQFWVKKGKIDGALLMKKLLVLNEYCLDPMIKRMVETQKLYHIGYLKNKHNTDNAWLNGTIIHVLDETGGCFTPYPVHTEVLAGQYRWQVLPYFTTAKEFAQFFVANYNVIHPLAHVMRYAITITAVLAISFPMMRTATAKSILFMPAMAGASPSHVKSMIPLAENLLKDGHNVSMVQYYNEDREKVTHDTIHFIYMLISGRKLIDEEQQSTIWGTRGKDPWMIVKIASRASAACLRSMHTEGQKQFYKKLSAFNWDLLIVDNLFQPCGIIFSTNTKGQAWIDYSTTLLLKYVRRFRAVSVPPSVDLSPLVMEVFQPTIFKNRFLTSIELVLEYAVSFGLAVAMTTPWRGEGAMFSTKHVSNFHTNAVYSLASLSSKLDIALPQSMNTFSMDYACPKAAKLSREYQNFVEDPSSNGTIVFSFGHIADWKEAPIELIKAVSSAFESLSQYRIVWQFNGNVSTVSSSRHLRIEPWIPLPSLLQHPKTVLFITHSGMKSFREAICFTVPMVSIPLFGDQVRNTILTKFHGLGVSLDKTQLTEESLYKTILNVLHDGGYKRRITKLSAMLSDNLMDETAKGSFWISFYLRHPKSASHMRLKGATMTSVSYHSYDILTFICLAITLIAMLAISFNIKKTVKGKSILFMPAMGIPSHVKSMIPLAENLVKNGHNVSLVQYYEEESEKVTHDTIHFIYLFVSGGKLIDEEQQITIWRRRGMNPWAFAKTAWKTSAACLRSTYTEAQKEFYQKLSTLNWDLLIVDNLFQPCGIVFSTNTKGQAWIDYSTTPMLRHIRRVRAVGVPPSVDLSPIVMDEFQPLNFKNRLFSIFELILEHSLKLSFAFAMTTPWRAEGEIFSGKNVLDFHINAVYSLGSLSSKLDIALPQSMNTFSTDYACPKAAKLSHEYQNFVEDPSSNGTIVFSFGHIADWKEAPIELIKAVSSAFESLSQYRIVWQFNGNLSIVSSSPHLRIEPWIPLPSLLQHPKTVLFITHSGMKSFREAVCFTVPMVSIPLFGDQVRNTILTKFHRLGVSLDKTQLTEESFHKAILNVLHDGSYKHRITKLSAMLSDTLIDGTAEGGFWISAFLRHPNIASHIHVKGTSMTFLSLHSFDVLAFIKRVALLKVTTDYGEATKKDTACAVSVPPCTSSQGKA

SEQ ID NO: 7034 - protein, 431 aa, Stomoxys calcitrans
MFFENRRFYNHFLEFFMLYEWGKEACNHTLRSEALQKVLRNKVRYDVILLEQFNSDCMMGVAYMLQAPVIALSSCAMMPWHYERMSMPIIPSYIPALFMGQSEEMTFGGRIANWISFHGLNAMYNMFSIPAADALVRYKFGHDLPSVGELVKETSMMFVNQHFSLSGAKPLPPSVLELGGVHIQKSKPLDVDLQRFLDNADHGVVFISWGSMIRAETLPAAKRDAIVKAAKRLKQRVIWKWENDTLTNKPDNMFISKWLPQRDILCHPNVKVFMTHAGLMGSSEAAYCGVPVVATPMYGDQFLNAAAMKQRGMGVVLHYEDIEENNVIKAIKKVLEKQYFDNAKMVAYGFKHRPETALQSAVWWVEYVANTEGGPLLQSKAKHLSRFTYYSLDVYMIFGLIGLISMITWGVLMHKIRQSAKRNKANKVKSN

SEQ ID NO: 7035 - protein, 2680 aa, Trichuris suis
MSKCRTHDSYAMGNHCKLTLPYKNSLTNQAASVGATMVLLWLLTLSLLVQPAVQESREWRNERKGFQQAAINFFFSRMAPIKILHLKFSEYDKCPHKNRSPYGIGTFTLRVSCPNPDPSYCGLYGTRRDGSEVMVVECQFAAELNGRGRPIAALCYQNTTTGGRGSRGEAVGGEMCKKWRYPGTELPQLQLPGYLRSPDADVLWYDPANLESFDVSGSRSREVLTTRWIRNRYERTGFSGKGKLEEYGANMALYLLITRYSYGTTKVLIEDTDDRVALPRFWVKKDKIDADLIKRKVSKLNLYCKPSDINVMVKTRQKYHTGYLKNKHNTDNAWLEGPIIHLHDQSDQGCFSPYPVHADAKSRQYRDGYEVMVVDCQFAAELNHPGKVIAALCYQNTTTGGRGSRGEAFGGQMCKKWSYPGTQLPQLQLPEYLKSRNADILWYDPANLESFDAYYSKSREVRTTRWILNQYERTGFSGKGKLEEYGANAALYLLITRYSHGTTKVLMEYTDDRVTLPRFWVKKDKIDADLIKRKVSKLNLYCQQSDINVMVQTRQRFYTGYLKNKHNTDNAWLEGPIIHLHDQSHSGCFSPYPTHTDARSRKYIYYYTKRFRADLRDKLKPQEDDIDIIAQHDISGRSVKLPVLIDEVIAVPVGMSMDDICDKWRYPGSDFPQLQIPDYMKSVHSDVLAYMPPQIEKRGFSASFFDNSWPKNRHERTGFGGLGHLGKFGPNYVLYLVVTSKNGYELKIVTEESDEPFALPLFISEDKKVGKPFITKCAENIRDEMGNCSDAELRLIVKRRRVLHEEYLKDRLNTDNAWMEGLIVHLHDSNGRCFACKLTKKFSEKELHLRYLCGNPLPKRAPLGNALGNPTENDATDRKRATTFFFQVLQPIKILDITLTEFDKCSHKHRSPYGTGRFTLKVSCPNEDPSYCGLYGTRMDISEVMIVDCQLSATLNGHDNSRVLAALCYQDTIIGSRGSAQEVTARPLCKKWSYPGTELPQLQLPGYLKSPDADVLWYDPANMETFNEDNSKSQDVDTTRFIRNPYERTGFSGKGKLPEFGANVAMYLVLTRHTYGTTKVLIEDTDDYTALPQFWVKKGTVDGDFIKRKVLKLNKYCKESEIGLMVKESQKNKELHLFNSMKAERGGEVQKKDLKLQEEVTAEELCKKWSYPGTELPQLQLPGYLKSPDADVLWYDPANMETFNEDNSKSQDVDTTRFIRNPYERTGFSGKGKITRIWRERGYVPRTNQNKELHLFNSMKAERGGEVQKKDLKLQESYCGLYGTRRDASEVMIVDCQLSATLNGQDNSRVLAALCYQNTTTGSRGSAQKLPTEPLCKKWSYPGTELPQLQLPGYLKSPDSDVLWYDPANMETFNEDNSKSQDVDTTRFIRNPYERTGFSGKGKLPEFGANVALYLLITRHTYGTTKVLIEDTDDYTALPQFWVKKGTVDGDFIKRKVLKLNKYCKESEIRLMVKESQKEVTAEELCKKWSYPGTELPQLQLPGYLKSLDADILWYDTANLETFSEDNSKSQDVDTTRFIRNPYERTGFSGKGKITRIWRERGYVPRTNQFWVKQGTIDGDFIKRKVLKLNKYCKESEIGLMVKESQKYHRGYLKNKHNTDNAWLEGTIIHLHDDTGECFAHTAKFTCMHFQSATAALSEWAFVGKEAFEEEVSKFFVTKLAPIKILHVSFSAFDRCPRNQSNPYGVSKVRMKVSCPQEDASGCGLHRTSGDITEVMIVDCQFAAEIVGYAVGRPLAVLCYQNSTSSTELATADRREWPPPTRQEFEDGAKRFFRRKLSPIKILDFIFSGFDTCPFKGKGPYGVGKARLKVSCPYQNASVCGLNRIGEDVTEIMIVECQFAGGAGRLVAALCYQNNMKTCGQSMEELPTPTGVLCKKWRYPGTELPRLEVPEHLKSPHSYILFYNPADMESFYGYRSSKDEFGRPKWPKNPYERTGFAGRGKLPEFGPNQALYILITRHTYGTTKLLIEDTDDYVGLPQFWVKKGKIDGALLMKKLLVLNEYCLDPMIKRMVETQKLYHIGYLKNKHNTDNAWLNGTIIHVLDETGGCFTPYPVHTEVLAGQYRWQVLPYFTTAKEFAQFFVANYKALAVMGEDSTPYHRAGVRSSAAQLTGVMLYNEAAGGINQSRHTGLQPVYRQLHLCGIKTKEKNVGQTSLEPVRYHVVAISFPMMRTATAKSILFMPAMAGASHVKSMIPLAENLLKDGHNVSMVQYYNEEREKVTHDIIHFIYMLISGRKLIDEEQQSAIWGTRGADPWMILKITSRASGACLRSRYTQSQQEFYQQLSALNWDLLIVDNLFQPCGIIFSTNTKGQAWIDYSTTLLLKYVRRFRAVSVPPSVDLSPLVMEEFQPTIFKNRFLTLIELVLEHAVSFGLAVAMTTPWRGEGAMFSTKHVSNFHTNAVYSLASLSSKLDIALPQSMNTFSMDYACPKAAKLSREYQNFVEDPSSNGTIVFSFGHIADWKEAPIELIKAVSSAFESLSQYRIVWQFNGNVSTVSSSRHLRIEPWIPLPSLLQHPKTVLFITHSGIKSFREAVCFSVPMLSIPLFGDQVRNTILTKFHGLGISLDKTQLTEESFYKAILNMLHDGGYKRRITKLSAMLSDNLIDETAKGSFWISFYLRHPKSASHMRLKGATMTSLSYHSYDILAFICVLLFAFHCSIHS

SEQ ID NO: 7036 - protein, 556 aa, Ooceraea biroi
MKITVTSLAVIACLLVAVDGARILAIFPFQAKSHYNVYEPLLKRLSARGHEIVAVTHFPQRTRLANFTDVDVSSTLPSLVSSVPFSDFGEFTILQNIRYVTRYLGVEICEPVLNHPKVKRIIETRERFDMLIIEIFATDCFLGIAHALSIPKVVGAISSVALPWSNEVLRNPENPSYIPNWFSPYTGRMSFLERSINTVGLLITKLIYRTVSDGPSYEIARKHFGYDLPDFGVLRSRISLILTNGHPAVSTPRPFAPGFKEIGGIHIPISGPKPLPVDLRDYLDSHGRNGVIYFSLGSQIDPSTIPSQVFAALYRAFEQVPQQILWKCAEGRMPPLPGNVKCIEWAPQLSVLCHPNTRLFITHGGLLGSQEAVYCGVPILGIPLFGDQHLNMAYFEEKGLALRLNFRQLSYEQLSSSLNELLSNNSYTETARKASIQFRDYLVPPLEEAVYWIEHTLRHDADVLKTTATELTWYQYLLLDVPLDDCSYVWQVSAEERCEWVSNTEDCYSDSMIQYTILLFCYFKSENAATLAGGLSLVLLWLFYLFLILGSTADNL

SEQ ID NO: 7037 - protein, 1067 aa, Neodiprion lecontei
  MOD_RES (440)..(440): Any amino acid
MRMFGFNVLLVIIAAISPGEAYRILGVFPLNGKSHFVMFDQLMKGLAKRGHQVDVVSHFPLKKPLPNYTDVVDLSGTMPAVLNNMTYDFVKSVLTNSAVVPLLATQFGGELCDLMDHPRFREIIKNPPKDPPYDLVITEIFGSSCYLALGQHFNVPVVGVATCVLMPWTNDMVANPDNPAYIPNVLSDNFAPMNFFQRVKNALSLWKAKWDFNSYSAYQDDKIKKYLGPNSISLREAERNVSLILANSHYSLHGVRPYTTAVVEVGGLHIPQEVDALPKDLQKWLDDSKDGFVYMSFGSMIKIESFPKETLAALYNSLKKLAPVRVLIKIAKPQELPPGLPSNVLTLSWVPQVPVLNHKHVRVFVTHGGLMGTQEAIHCGVPMIGIPLFGDQMQNIKLYVRKKIAVALDHDQLTEEKLDTAFRTVLGDPSYLQAARKFSXEFRDRPMRALDTATFWIEYVIRHGGTNLKSPAMELTWGQTSLLDIYGALFLSVALSAYLVKVIITTLIAIVTGSDISSVKHSKKVQPVKAILYRQKKIRGHKMRLFGRIILFVVMLTISHDEAYRILGIFPLRTKSHFLMCEQLMKGLAKRGHVVDVVSPFPMKTPFPNYNQIINLEGSVIGLHNNLTYDFALSNLLDKAIIPVIATTYGNDLCDLMALPEFQKIIKNQEDSPYDLVIVELFGANCYAALGQHFKVPVVGVVTSAVWPWVNDVVANPDNPAYIPHTFSGLDVRMNFWQRFQNALTLLKVKFEYWYYSDKQNEQIKKYIGNHAPSLDEAMRNVSLLLVNSHYSLNGVRPITMAVVEVGGLHIADTPDPLPNDVQQWLDDSKDGFVYISFGSMVKIESYPTKSLNALYASLAKLAPVRVLMRISKPNELPPGLPSNVMTRPWISQFAVLRHKNIKVFVTHGGLMGTQEAIYCGVPMIGVPLFGDQMQNIEFYAEKKIAVSLDHENLTEENLDAAFSTVLNDPTYLKTAKRLSEEFRDRPMTAMETATFWVEYVVRYGGTNLKSPAMELTWWQTELFDVYGALLLAASLAVHLLTVVISKLSAIVLRTEKRSVPRSKKTK

SEQ ID NO: 7038 - protein, 535 aa, Caenorhabditis briggsae
MIIKHACFVLFLLLVGYGNSSKILIHNPIFGFSHVKFISKLADIIADHGHNVTLFQPYHLALKNLDGLVKNQNVEILNYYPSHYDELLKKETQTFPMFWDSHLIGNPVLRAFMLAPVLGGEFKKTAMEVLSDKNLINELKSKKFDVVMAETWELSGIYLAHLLDIPCIPMMSTVRYPIFNQIFGQPSFVGHVPQMGSVGAPEAGFFDRLNDVFETFWGIIAQERLNSYQNQFIEEAIGRSVPYWKDLVKQSPIYITNSNSYLDYAVPTTATIVHVGGITMDLKKMKNGEPLSEEYEEILQERESTVLISFGSVIRSFEMPENFKAGLIKMFESLPDVTFIWKYEKDDTEFKKRLPKNVNLKKWVPQPALLADHRVKVFVTHGGLGSIMEVAYTGKPAIVVPIFGDQNHNANMLARHGGALAYSKFDLPDGKKLAGVIKEMISNQKYKQNAETLFHVISNQPIDPTHNFLTHLDFAIKFPNLRSQVPEINQVGLIAHYYLDVVLFLCILGIAFAYLSFKLVKRILRRFAGEKTKTD

SEQ ID NO: 7039 - protein, 291 aa, Alligator mississippiensis
MTVPELFSHASIWLMKYDFVFEYPRPMMPNMVCIGGTICGQQKPLSQQFEAIVNASGEHGIVVFSLGSMVSEIPMKKAMEIAEALGKVPQTVIWRYTGEAPPNLSKNTKLVKWLPQNDLLAHPKTRAFITHGGSHGVYEGICNGVPMVLMPLFGDQMDNAMRVESRGAGVTLNILEMTSKDIADALNTVINDIRYKENIMRLSALHLDRPVHPLDLAVHWVEFVMRHKGAPHLRPAAHDLNWIQYHSLDVIAFLLAVVLITTFISFECCLFCCRKCFCKKGRDKSSKSKMQ

SEQ ID NO: 7040 - protein, 527 aa, Dictyocaulus viviparus
MQYRLLLLTILLVNSDSYKILVINPKFAYSHMNFMGKIADILVDAGHDVVTFQPIIDMYLVGNGTTKSRLIQTHMVKRLEAEMETLHRRETQEPVWTANVINPIGVLAFLPLLNELVENTLSEVLDRKEVLNQLKSENFDIAITELFDFIGFGVLEAIGVKNIIGAHSSGCVIEGTALSIGLPIFPSYMPASFGITSDLSDLSTRASNLLFTFLSWYFQTSVAKTAERVMMKKLGTTATPIWETVSNMTWVLINSEPLLDFSTPTLNNVVTVGGLGVHDPKPLNEEWNRTLSLRQRTVLISFGTVAPSMFMPNSMKQAIIKVIKSYPNITFIWKYEQDNEPIMNGMENLILSKWLPQADLLADKRLTLFITHGGAGSMMECATQGKPMIVVPLFGDQVRNARLIEKFGVGILLYKAQLWKSSILHDAIATIINDNSYRIAAQRLQRLLSKRPYSPREKLIKTIMLAGEFGNLPELHVTGRKLNLFVYHNIDLILLILLVTGMFTLIIFYVTSKLVMYCVGNEKIKGE

SEQ ID NO: 7041 - protein, 423 aa, Danaus plexippus
MTFSDVRGTSMFMRAIFRAQLETEEVQKIISERPKFDLILIESINRLGLSYSHLFKAPVILVSSFTAVFDNHNVMGSQTHPFLYPISFRDRIYNLSLTEKLKQLYIHFYVEYADYLNRKEENSFLKEIFGPQCPSLNEMNKNVDMLLLNIHPMWVDNQPVASNVIYMGGIHQLPEKKLPQELQKYLDSSKKGVIYVSFGTNVLSQVFPEDKLKIIINVVSRLPYDILWKWDKDELPIKASNIKLSKWLPQSDLLRHKNVKLFITQAGLQSTDEAITAGVPLVAIPMLGDQWFNAEKYEKFGIGIKLDVKTLTTDQLSKAIETVISDESYRHNISKLRGLMHDQPEPPLNRTMWWIEYVLRHGGAKHLRSAGANMSYWEYFETELILVILLGIFIIVAGISVVGFMLIHFISQFSKTTKKLKTN

SEQ ID NO: 7042 - protein, 530 aa, Mus musculus
MVPAAFPTSLPLCVCLLLASGLVQAGRLLVVPMDGSHWFDMQMVVEKLIQRGHEVVVVIPEVSWRLGKSLNCTVKTYSVSHTLEDLDREFKYFTYTQWKTPEQSIRSFMTGSARGFFELMFSHCRGLFNDKKLVEYLKQRSFDAVFLDPFDVCELIVAKYLSLPSVIFARLSFCYYLEEGAQCPSLLSYVPRLFSKYTDTMTFKERVWNHYMYIEDYVFCPYFFKTAVEIASEVLQTPVTMTDLFSPVSIWLLRTDFVLEFPRPVMPNMVFVGGMNCLQGKPLSKEFEAYVNASGEHGIVVFSLGSMVSEIPEKKAMEIAEALGRIPQTVLWRYTGTRPSNLAKNTILVKWLPQNDLLGHPKTRAFITHSGSHGIYEGICNGVPMVMMPLFGDQMDNAKRMETRGAGVTLNVLEMTADDLENALKTVINNKSYKENIMRLSSLHKDRPIEPLDLAVFWAEYVMRHKGAPHLRPAAHDLTWYQYHSLDVIGFLLAIVLTVDFIVFKCCAYGCRKCFGGKGRVKKSHKSKTH

SEQ ID NO: 7043 - protein, 981 aa, Ancylostoma ceylanicum
MLPFKTLLFLPLLFPCTFSYKMVLFVPDMANSQVLFNSRVAEALAKAGNDVTMVMISGMSDFDSKDVKIMKEVKLHRVNASFGMSRKELQERQSKIHYEDIPVWDSRVRENLRQMTGLLIKSCRKLVENKEFLEWLAGERFDLAFSHMYDICPIGLIHYAKIPSWIWLNSGALMDFVAYYMGVPIIPSYMPPIAMESSDHMNFLERTKSFIGHMLTSLLWKRLFADGETAIFRELIDPNFPDIVDVAKECPLVMVNSNELYDLPRPTLAKIINIGGIGIQLKDVKPLSPEFQQIVDAAEGIVVFSFGSVAAGHKMPMSWKLAFVDAFKRFPKYHFIWRYEGTDLQDEVSPNVHLFKWLPQSDLLQNPKTKAFLSHGGYNSMQEAISAGVPLVTIALFGDQPKNAKLAERHGFSVNIHKGDLSADTIADALNKLFKDPSYSQKIKRLSQMARKKPMLRLLILLLMIYSTCSYKMVIFVLDLSNSQLLFNKRVAEALADAGHDITIALIVPQSDLDNSDIKIKSGIKTHVVNAPINLTRKAMEERMEEYVFKESDSKMFGRFSLQISMILDTCRATVENKELLPWLKREKFDLAFAHMFDVCTVGLVHAARIPSWIWLNSGSVIDYVANLVGIPLIPSYVPPIMMSAAGEMNFLQRTKSLIGHGLMKIFWKRLIADPETELFRTHVSPDFPNLMELAAKCPLVMANTNELYEAARPTLAKVVNIGGIGMEVKDSKPIPEHIAKIINAGDVTVLFSFGSVFAAYRMPIEVKKAFLETFRRFPRYQFLWRYEKDDIKDMLPPNVHLFKWLPQSDLLRHPKTKVFITHGGFNSIQEAIHSGVPVISIPLVGDQPKNAALAEHHGFGITLRKGEISVESVSRALEEIITNTKYRDAVKRLSKMMDHKPVSPTHLLVKWAEFAAEFQTLENLEPAGNKLNFFQYHSLDVIFFLAFILILIVVFSIVLTKHLLRRVIALIFKSKKQKTT

SEQ ID NO: 7044 - protein, 407 aa, Caenorhabditis brenneri
MMKSNCEDFTSNKKVFDQLSTMNFDVAIAEPVSVCGLGYFDALGINKTILASSTTHYEGVVRNTGEPVDMSYVPVHGAYFNEKMDIFQRYTNWAAEHVMAGNLEKMFDEEMERYQKNLGVNVKHWRDLIPSASLMFTNANQYLDFPRPVLQKTVGIGGISVNMEKIKSEKLSEEIGEILDKRENNMLISFGSMVKSSTMPENWRNSILSSIKQFPNITFIWKYEKDDLEWANGVENVHFLKWVPQTALLNDKRMTAFLTHGGLGSTNELAYIGKPAIVVPIFGDQGRNAPMLARHGGALVLHKFDLEKEDILVDFIQKIVFDKSYSQKAQELSKLLNSSPFPPKELVVKHTEFVAQFGPLTQMDPYIRQLNWFQRTFADIYIIMFLFYSFVIIVPLYIFRLIYRFLL

SEQ ID NO: 7045 - protein, 524 aa, Aquila chrysaetos
MLVAVLVPFLCCLSLATAGKLLVIPMEGSHWLSMKEVLAELSKRGHEIVVIAPDSKMLIDSSGIYELKMYPVPFKKEEMEELMRSLSANCFSEEPFLMRFFNTWDNFRKTSAMFQTSCSSLLYNKEIMKYIKESKFDAIFTDPLTPCGQIIALHFSIPTVFFLRGIPCAIDIHAAQSPDPPSYIPRMFSLNTDHMTFPQRVKNFLISISETFTCSMVFSPFESLASDFLQKPITITQLLSHGSIWLKRLDFVFDYPMPVMPNMIFIGGINCGQKKPLSQEFEAIVNASGEHGIVVFSLGSMVSEIPMKKATEIADALASVPQTVLWRYTGEVPPNLPKNVKLVKWLPQNDLLAHPKTRAFITHGGSHGVYEGICNAVPMVLMPLFGDQMDNAKRVESRGAGLTLNILEMTSKDISTALKAVINDKKYKENIKRLSDLHLDRPIHPLDLAVHWVEFVMRHKGAPHLRPAAHDLNWIQYHSLDVIAFLLAVVLLSLFISFKCCLFCCRRCCCKKGRTRKPTKSKSH

SEQ ID NO: 7046 - protein, 527 aa, Caenorhabditis remanei
MLSIKFMFSLIIFNYVSPAPSLNILVYSPIFGGSHSKFMGNIADTLTQAGHNVTFLVPVADVTRRHEVGVKLTKNVMVVDKPNYNPDAAFNIDMDEVLRPLWTIQNRPSDFATCFTFFLEMMRTNCDDFTSNKKVFEELSKTKFDVAIAEPVSICGLGYFNALGIHKTILASSTTHYEGVVRNSGEPIDMSYVPVHGAYFDEKMSIFERYTNWAAEHVMAGNLEKMFDEEMEKYRKNLGVGVADWRELIPEASVFFTNANQYIDFPRPVIQKTVGIGGITVDMKKIKSEKLSEEIGKILDKRDHNMLISFGSMVKSSTMPEIWRNSILSAIKKFPNVTFIWKYESDDLKWADDTKNLHFLKWVPQTALLADSRLSGFLTHGGLGSTNELAYLGKPAIIVPIFGDQGRNGPMLARHGGAIVLNKMDLENSEVIADLMRKIVFDRSYAQKAADLANLLNSSPFSPKELVIKHTEFVAKFGPLTQMDPYIRQLNWFQRTFADIYILMFLFYSVVLIVPFLVVRKIYRLIF

SEQ ID NO: 7047 - protein, 531 aa, Rattus norvegicus
MGIQGFLQKLSGLLLLLCALPWAEGGKVLVFPMEGSHWLSMRDVVRELHARGHQAVVLAPEVTVHIKEEDFFTLQTYPVPYTKEEYRHHLLGHLQNFFETEFSLKLVLQRMAAVNNVSTFYVRSCRGLLHNTALIQSLNSSSFDVVLTDPFFPCGAVLAMYLRVPAVFFLQSMLCELEFEATNSPNPSSYIPRLLTLNSDHMSFLDRVKNMLYPVPWMYLCHVNYGSLARLASDLLQREVSVVEILRHASVWLLRKDFVFYYPRPFMPNMVFIGGINCANRKPLSQEFEAYVNASGEHGIVVFSLGSMVSEIPEKKAMEIAEALGRIPQTVLWRYTGTRPSNLAKNTILVKWLPQNDLLGHPKARAFITHSGSHGIYEGICNGVPMVMMPLFGDQMDNAKRMETRGAGVTLNVLEMTADDLENALKTVINNKSYKENIMRLSSLHKDRPIEPLDLAVFWVEYVMRHKGAPHLRPAAHDLTWYQYHSLDVIGFLLAIVLTVVFIVYKSCAYGCRKCFGGKGRVKKSHKSKTH

SEQ ID NO: 7048 - protein, 532 aa, Danio rerio
MTSGALLVCLLLCGVDVGWSGRVLVMPGEYSHWHNMRPVIEALVDKNHSVTVLVGSSSPTVPHTQKERFDYHVFKVNMDKEEADAAMRDMIHLFTNDTAAKYEGEFMMWKVMSKFVEFGDVYFRSLFDVGLLKTLRDSNYDVLFSDPMMPFSDLMAQKLNIPQVISMRATFAYAAERLCGQMPAPPSYVPAVALTDHLTDRMSFMERVENMLLYIVHSIAFPLVATFTFDGYYSEILGKPTTMCETMGKVDICLIRTYWDFEYPRPFPPNFKFVGGLHCKPAKPLSKELEEFVQSSGDHGVVVFSLGSMIKNLTSERANTIAAALGQIPQKVVWRYSGKTPETLAPNTKIYDWIPQNDLLGHPKTKAFITHGGTNGLYEAIYHGVPMVGLPLFGDQPDNLLHIKTKGAAVVLDIHTMGSKDLVDALKAVLNNPSYKESIMRLSRIHHDQPMKPLDQAVYWIEFVMRNKGAKHLRVQAHELSWYQYHCLDVAAFLLSITALITFLWVKACCFLFRRCVRKTRPERKTQKNKKE

SEQ ID NO: 7049 - protein, 517 aa, Acyrthosiphon pisum
MARMKRSTVQVSLSLCLCWLSVVLRTIPVGEASRILAVETIAGKSHWYFMSSVLRSLTDAGHTVTVFTPFPDGDRANYTEVDTSRDFPLKLDMDVMQTIREFRDPFMLTNLMSGLARFYCDAVYGNRKLAELIASEPRDRYDLLLIEPLGFDCVSYLADVLGLPVIYSIPSPMLTFTERLFTGHLSNPACVSNMLASHAVPNTFVQRFSNTALLTYGMIKTQYDQLVTLFTDPRPYDLAPTVNPSIIFQNTHYISESPRPITPNVIYVGGIHLKPPKTIPKDILDFIENSPQGVIFFTFGSTIKVSSLPENIEQSFKEALANVPQRVLWKYEGEMKDKPKNVMTRKWFPQREILLHPKVKLFISHGGMSGVYETVDGGVPVLGIPVFYDQPRNIEHLVHNGMAISMDLLSMTKEKLSNAISELINDEKYAKNAKIASNRFKDRPMTPQQSVVYWTEYVIRHKGAPHLKSQALNLTWYQYFLLDIMAVAFIFVFLVTFVVFKIFKCIKSFKNDKVKTQ

SEQ ID NO: 7050 - protein, 531 aa, Haliaeetus leucocephalus
MTVMWRNQIYAGLVLFLPFWSLAEGGKLLVVPQDGSHWLSMRVVLEKLWERGHEIVAVIPDATLLMKSSQSFTIKTYSVPYTQEFVDRYYHSIGEKSFDNSPFLEKFTILFSNISEMTSMFSSTCRHLLYDEELMKYLQESKFDAIMVDPVLPCGPIVAEYLSLPSVYFMRGLPCILDYKATQCPSPFSYVPRTFTSSSDHMTFMERVKNLLVGFSEPLFCYLFYFKYENLASEFLHREVTILELFSKASIWLMRYDFVFEYPRPIMPNMVYIGGINCEQKKPLSKEFEAIVNASGEHGIVVFSLGSMVSEIPMKKATEIADALASVPQTVLWRYTGEVPPNLPKNVKLVKWLPQNDLLAHPKTRAFITHGGSHGVYEGICNAVPMVLMPLFGDQMDNAKRVESRGAGLTLNILEMTSKDISTALKAVINDKKYKENIKRLSDLHLDRPIHPLDLAVHWVEFVMRHKGAPHLRPAAHDLNWIQYHSLDVIAFLLAVVLLSLFISLKCCLFCCRRCCCKKGRTRKPIKSKSH

SEQ ID NO: 7051 - protein, 533 aa, Ursus maritimus
MAAGFLVPLPALTGLLLFLCVGPWAEGGKVLVVPMDGSHWLSMKEAVQELHARGHQMVVVLAEVNMHIKKEDFFTLTTYATPFTQDEFDRLLLGQAYLVFERKSFLTMFLEIMERLKTTVVIFQRSCEELLHNKELIRHLNASSFDVVLTDPVYPCGAVLAKYLSLPAVFFLRTIPCDLDFEGTQCPNPSSYIPRLLTKNSDHMTFLQRVKNMLYPLALKYICHVSFAPYASLASEVLQREVSVVDIFRFASVWLFRGDFILDYPRPIMPNMVFIGGINCANRKPLSQEFEAYVNASGEHGIVVFSLGSMVSEIPEKKAMEIADALGKIPQTVLWRYTGTPPPNLAKNTRLVKWLPQNDLLGHPKTRAFITHSGSHGIYEGICNGVPMVMLPLFGDQMDNAKRMETRGAGVTLNVLEMTSEDLANALKTVINDKSYKENIMRLSSLHKDRPIEPLDLAVFWVEFVMRHKGAPHLRPAAHDLTWYQYHSLDVIGFLLAVVLGAVFIAYKCCVLGCRKCFGKKGRVKKSHKSKAQ

SEQ ID NO: 7052 - protein, 527 aa, Trachymyrmex zeteki
MKMLLSVLFVILAFDQIASSYRILGLFPLNGKSHWNMQEVLMKELARRGHQVDVVSHFPLKKPIPNYKDISLKGSVPEVTNNMTATQALSFSTPSMAALVQMVGSNTCTLFNHPKIQELIKNPPKDPPYDIVILEMFASPCYMAFGRHLKVPMVGTVASVFHDWLSEVSANPMNPSYIPNMFSGYSQHMSFKERLTNFLVTHYLSWEFHYYTNKQLKLVNEHFGMNLPHIKDLYNDISLYLVNSHHSLNGIRPMTTNVIEVGGLHLSDEGDPPSPEVQKWLDESKDGCIYFSFGSMVRIETFPKELLQQIYLSFEKIAPVRVLMKIVKKEELLPGLPKNVMTQSWFPQIAVLKHKNIRAFITHGGLHSTQETIYYGVPMIGIPLFGDQRVNIKNYINKKVAISLNSINDVTEEKLTSALNNILKDSSYRENVQKLSKLFFDRPMNALDTAIFWVEYVAKFRNVLQSPGIKLNWWQRNLVDVYAFIFTVIITVLYIALFIFRKLKKLLFGSRTCAKKDNIAMKSKKNK

SEQ ID NO: 7053 - protein, 632 aa, Pieris rapae
MPAYLQLCITALIYINHIQAYNILAVLPYPGRSHHVAFLPFFKELARRGNNVTLISHYPQEKPLKNLNEIILSEKEFQNWVPVTSPSYLTVLVAGVVLVYTGAASCKTLLDNRGVQDLWKNRTNFDVVLVEQFNSDCSLGLAYELGAPVVGITANSLMPQHYKRYGVPDNPSYTRNQVLGGRTRGTLFERVERTLIGIYINYMVDFASQFLDEYYLRQYFPNIPPIKELEKNIKFLLLYQHFVLNSALLLPSNVIEVAGHHVLEPKTLPKDLKRFIEESKHGVIYISFGSMIKATSLSKYKLQAILDVLEELPQRVIWKWDNDNLPFEMKKIYSSKWLPQNDILAHPNVVAFFSHCGQVGITEAIHYGVPVLGIPMFGDQISNAAAVEESGLGVQTAVNDLTKENLMKKFKTILDPDFRSNVKTLSRMYRDRPVSSLNASVFWTEFVARYPNATFRSPILNVPLYQYYCFDVLAVFILLLLLIFMLVKAAIRCLSITPNRPTMALIDRWLESTNIGLAVNRTETKLMLVDRASKFPRVTCNIPGINIVGRFIYLGSQISNDSSSVPEIKSRIGMAKDAMTRLGNIWKKRGIGINTKIRLIRVLVFPIFLYGVETWTILARERQRIDALEMWC

SEQ ID NO: 7054 - protein, 532 aa, Meleagris gallopavo
MTLRLCYPLATWTFILLIPGLSEGGKLLVVPMIGSHWLSMKEVAHKLAERGHEVVVLKPEVSWNTGDKHGHAYTVKTYPVSTKLEDLDNTFKVYLETHLKSMPFPKNVIAIFNDFTRLFESFYSQCKEMFSSMETLQYLNESSFDAVLTDPFFMCGATVANYLSLPFVFFMRGLPCNLHFEAAQCTSPLSYVPRTLSFNSDHMTFFQRVENTLISLLELFYCNAIYQDAIKFSSEILQREVTLLDLLNSASISIMRFDFVFEYPRPVMPNMVFVGGMNCAEKKPLPKEFEAIVNASGEHGIVVFSLGSMVSEIPMKKAMEIADALGSVPQTVLWRYTGEVPPNLPKNVKLVKWLPQNDLLAHPKTRAFITHGGSHGVYEGICNAVPMVIMPLFGDQMDNAKRVESRGAGLTLNILEMTSKDISDALKAVINDKKYKENIQRLSELHLDRPIHPLDLAVHWVEFVMRHKGAPHLRPAAHDLNWIQYHSLDVFAFLLAVVLLILFISVKCCMFCCRRCCFKKGRKSKSGKSKTH

SEQ ID NO: 7055 - protein, 531 aa, Pelodiscus sinensis
MVTALLLGYQLAAWTLLLIVPGFSEGGKLMVVPMDGSHWLSMRPVVENLSQRGHEVVVVIPEVRWQLGRAVNYTVKTYPVTYTREELDGSFQRYLYTHLKGQPFPFNVLSIYNTSVAVFSLLFTHCKSLFSQRELMHYLKHSDFDAVLTDPISLCGAIIANYFSLPPVFFMRGFPCNLHYKANQCPDPLSYVPRLFTMNSDHMTFSQRLKNVLVDSVEFLYCNGFYAEALKFASEVLQRDVTMLDLLNSSIWLMRYDFVFEYPRPVMPNMVFIGGINCGERKSLSEEFESIVNASGEHGFVVFSLGSMVSEIPMKKAQQFAEAFGTIPQTILWRYTGQPPPNLANNTKLIKWLPQNDLLAHPKARAFITHGGSHGIYEGICNGVPMVLMPLFGDQMDNAKRIESRGAGVTLNVLDMTSKDLSAALNTVIYDKSYKENIMRLSALHLDRPIHPLDLAVHWIEFVMRHKGAPHLRPAAHDLNWIQYHSLDVIAFLLAVVLVAMFISWKCCLFCCRKCFCKKGRVSKSSKTKAQ

SEQ ID NO: 7056 - protein, 443 aa, Anopheles gambiae
MLGGKNNVASVALLCLVFAIGHNSVVVESAKILGIFPTSSKSHWILGSALMKELAQDGHEVYYCPFPLKNAPKTYRDVKIDYKTGLFEAAMDKVFDNIDNSIVQKMTKLGNFANAITNTTLSSPEVQALLQSDETFDLVILEIFLDDALLGFADRFNCPVVGMSPFGASPWVNSLTGSPQPLSYVPHPMLSFTDKMNFWQRLGNVLFSAFDGTIISAMSNPIHQKHYDHYFPNATRSLDEMRRHGVSLVLINSHFSLSFPRPYLPNLIEIGGFHVNRKVNPLPEDIKSFIEQSEHGVIYFSMGSNLKPSKMDKQKRNDVIKVLSSLKQNIIWKWDDDTLVVDKKKFLIGKWFPQDDILAHPNVKLFITHGGLLSCTESIYHGVPIVGIPIFGDQLLNMARAEQSGWGIGVTYNELNEQTFSKAITTVLGDPRYVLLLNLVNSF

SEQ ID NO: 7057 - protein, 519 aa, Caenorhabditis remanei
MKYILFLTILISSTTPYNILVFCPLFGHSHSTFFGRLADILTEAGHNVTMFTPTIVDEFRNFSYTKLTKDVVYLDASPKLKAIGDLIAGNGRYWSQEFSLLEIPQSSRFFQSVANEQHNVLSENLPLLDKLKKKQFDLLLFETIFTCAIPLMDYLEIKAFAVAQSIAFESSSMRAIGEPVMPSHIPDLLTPSSDRMSLYERLLNTVTQTLQTFYKFSPEYYTSYSNPEERVYPLQRLPDASFVFTNSNPYVDFPRATIAKNIQIGGISVSMEAGKLEKEWDQILNLRNKNFLISFGSVTLSKDMTFESKVSLARAMKQFPDVTFIWKYEDSDTDKFAEGIQNIHFSKWVPQRELLADARLSAFMTHGGLGSVNEVSYMGKPSIMCPIMGDQMRNAKMLVRHNGSIEISKYDLGNSELVEEVIRKILYDESYKIAAQRLSDHLRNQPVSPKDLFLKHTEFAARFEKLPSLDPYSRQMGVLEYFMIDLALIVTVIVVVLCLFLYFLLKLVCRISGKRMKVE

SEQ ID NO: 7058 - protein, 511 aa, Trichuris suis
MRYAITITAVLAISFPMMRTATAKSILFMPAMAGASPSHVKSMIPLAENLLKDGHNVSMVQYYNEDREKVTHDTIHFIYMLISGRKLIDEEQQSTIWGTRGKDPWMIVKIASRASAACLRSMHTEGQKQFYKKLSAFNWDLLIVDNLFQPCGIIFSTNTKGQAWIDYSTTLLLKYVRRFRAVSVPPSVDLSPLVMEVFQPTIFKNRFLTSIELVLEYAVSFGLAVAMTTPWRGEGAMFSTNHVSNFHTNAVYSLASLSSKLDIALPQSMNTFSMDYACPKAAKLSREYQNFVEDPSSNGTIVFSFGHIADWKEAPIELIKAVSSAFESLSQYRIVWQFNGNVSTVSSSRHLRIEPWIPLPSLLQHPKTVLFITHSGMKSFREAICFTVPMVSIPLFGDQVRNTILTKFHGLGVSLDKTQLTEESLYKTILNVLHDGGYKRRITKLSAMLSDNLMDETAKGSFWISFYLRHPKSASHMRLKGATMTSVSYHSYDILTFICVLLFAFHCSIHS

SEQ ID NO: 7059 - protein, 523 aa, Aedes aegypti
MRLGSFYLLLWVVIDTALEHASSYRILGLFAHPGLSHFKVFHPIMRGLAEAGHQVTVVSYFPSLDKPHPNYEDFTFQGQELLTNAFSLEGFSRRTFLDNFVEFYELASWGFETCSSALNSPAMDKVLALHRSKPYDLIVTEFFSTDCMLGVSHVMKVPFVGLSSCALMPWHYGRVGLPDSPSYIPSEFSTFSERMSFWERFENWFVIRSVNLLYRIVEWNDNRLLTAKFGKGIPSVREIARNTSLILVNQHYTLSGARPLVPAVVEIGGVHIQNQKPLPTDVQKILDDSPEGVIVISWGSVLRASTLPQEKRDAIVNALRRLPMKVVWKWEDDSPKGLPKNVIVRKWLPQRDVLCHPNVRLFLSHGGLLGVSEAVHCSVPVVVTPIYGDQFLNAAALVNRGMGVTMHYNKITAEYVYQCIQTALHASIREAAIAVSEAYRHRPHTPVELAVWSIENVLKNGARRLEKSHGSELSMVVYNSWDVGLAFGIMMVLSLAAVVAISRKLSNVLFKKPKHASSKSKKL

SEQ ID NO: 7060 - protein, 533 aa, Felis catus
MAAGFLVPLPVLTGLLLFLCVGPRAEGGKVLVLPTDGSHWLSMKKALQELHARGHEIVVVSPEVNLHIKKEDFFTLRTYAISYTQEEFNDFFLGHSYLVFEKGHFLKMFLKIMENLKTASFIFQRSCKELMHNKELIGHLNSSSFDVVLTDPVYPCGAVLAKYLSLPAVFFLRSVPCDLDFEGTQCPNPSSYIPRLLTMNSDHMTFLQRVKNMLYPLSLKYICHIAFTPYASLASELLQREVSVVDVFSSASMWLFRGDFVLDYPRPVMPNMVFIGGINCANRKPLSQEFEAYVNASGEHGIVVFSLGSMVSAIPKEKAMEIADALGKIPQTVLWRYTGTPPPNLAKNTILVKWLPQNDLLGHPKARAFITHSGSHGIYEGICNGVPMVMLPLFGDQMDNAKRMETRGAGLTLNVLEMTSEDLANGLKAVINDKSYKENIMRLSSLHKDRPIEPLDLAVFWVEFVMRHKGAPHLRPAAHDLTWYQYHSVDVIGFLLAIVLGIVFITYKCCAFGCRKCFGRKGRVKKSHKSKTH

SEQ ID NO: 7061 - protein, 518 aa, Trichoplusia ni
MAVFLSILACILLVNTNEAARILGVFPTPSISHQVVFRPLIQELVRRGHNITVITTDPAFPKGKAPANLKEIDVHDISYNLWRKKLVSRKNNNDDILTQHSILLDLFVSMVDAQLKDENVKRIIHDKEQQFDLLILEACVRPALGYSHRFKAPVILMSSLGGLPYNFETIGIPVHPIHYPSIPRRRINNVSLLEKISELYVYYKNELLVRGYRSIEHEMLKKHFGPDTPPITELNKNADMLFLNINPVFEGIRPVPPNIIYMGGLHQNPSKDLPVDLKSYLDSSKNGVIYISFGTNVDTNSLPADKIQVLVKTVSQLPYDVLWKWKGDELPGRTDNIRISKWFPQSDLLRHPKIKAFVTQGGLQSTDEAITAGVPLVVMPLLSDQFFNAERYETHKIGIRVDLATVTEDQFKGALLNVIEDDSYRENIAKLRTLMLDMVQTPLERAVWWTEYVLRHGGAKHLKSPTANMTWAEYIELDLVLTGLAGLSVVMIVFIIFLRKLHKYVRCKIVAASKLKRN

SEQ ID NO: 7062 - protein, 424 aa, Dendroctonus ponderosae
MFLNFIFFVNFFNILLQECAAARILVFIPLPFYSHQSVYKPLWNELANRGHKITLLTLNPMQPHENITQIDLSAVYTRLEKAKFFDVLSSGEQSLENVLHVFDTVLEAADEELSHPEVKGLIAGNQSFDLVITEYYLTVGAAFAHKFQCPFIGKSSNYPQLENVHNIIGNPTHPILYPALDLGFSGELNLKLRLGRTLFYLAWNAYVTYSIRPRENELIQKHFGSEFPLVENLNKKASLLFINVNPVFHIQRPLNAQTINVGGGLHIQPPKSLPEDIQGFLDDAQHGAIYFSLGSSIRSSQLPGSTKSAIIQTFGQLPYKFLWKYEKELNDSMEVPKNVHLSNWLPQQDILRHKNIKLFITQGGLQSLEESLFIGVPVLVLPFYGDQISNAQMVVEHGFGLALDRRNVTVRNFMSAILKLITST

SEQ ID NO: 7063 - protein, 400 aa, Onthophagus taurus
MKANVISLFQILLLFFHITIIKSANILVVFPSPAESHFRVFALFFDQLALKGHDVDVLSHFPRNTPLRGYNDLSLKGHIMCSRVMNTTAAKQLKKTKKKYDLMITHMVKSHCMYGFADFFKIPIITITSSSILPWLPDVIVWFSFHSTVAANNYHKEFYGKKSTDLDKIVKKTNLMLIASHFSFHQSRPRPPNFIEIAGIHIKANQSLNEEFKKYLEISTNLKGVIYFSFGSYFNTETFPGHILQAFFDVFENLPYKVLWKGDIKKFPKTYNIPKNIHFIPRMPQIPILCSSKVNLFITHGGLSSTLETIYCGKPVLTIPIWLDQLSNANLLKAKGVGRSILFHEINKENFKAELEEVLENPKYSKNVKILSEIFRDRLHRWKQPFIGLNTSSDIKGLII

SEQ ID NO: 7064 - protein, 473 aa, Toxocara canis
MTQGKSHAGSFMPLLEELTQQGHNVTLFMDTYDNVSFAGRVNEWYINVKGHTNPHANFRYESDMWRDRFTFMTLTKPFYFGAQSCEHVLADYREEFNRLVNYPWSLILTDSLFAVSAYGISELSGAHYVLMHSSDVESGHGTLKGYARNYVMTPRSYLEFDAAEYDIRRFMDRVWTAYEWFGSWTTFTMVSNRYMRHALSPVLPNFDISRYSANSAMSFTDMPLHLHLPLSTNNELFSYGAYCRPYKPLNGEIADFVEDSQSKGTILIAFGTIVRWSTAPKEKLNAFVAALNEVPEYRILWAYSGPKLYTKKHIKIVKWLSQNDILNHNRTKLFITHGGLKSVKETTCATVPTLQMPMFAEQVRNSWLTRHHGFGRMINKVNFTSASLVESIREMITNPDYKNNVKRLRRFYDDTPIPALKEAAFKINRLLKYGGRMPDYFYTRSTKLSFFTFLNIDLLVLFPALSIFLLSIR

SEQ ID NO: 7065 - protein, 514 aa, Tribolium castaneum
MLKTSIFPVLLIFLVPELPETHSANILGILPYPGKSHSILFETLLKRLAEKGHEVDYVTFFPSRNFTQRYNELSLYGVVPNYVNNVSIDQLQNQSLYQAVKFMTRIAGADAFSTIMKTPVLQNLRNTTNKYDLIIVHSFGCDIALGFGYLFNAPVVAYVTSVNLPWIDDRIGNPDNPAYIQSYLSRSSAKMKLYERIENTIYWIMTRFWFSFFSGRSDRLVKKFFGPTTPSLENLIRNTSLVLVNSHFSMQQARPLVPNFIEVGGLHIREPQPLPKDLENLVSNNTFGVVYLSMGSMVRTESFKPEILQAMFDAFAELPYTVLWKASPEKFPKGLKIPENIHFKTWMPQIDILCHPNVKLFISHGGLLGSQEAVYCAIPRIGIPFFDDQELNIVTSEKLGIAKKLSYGHINKNTLLNTITELFEDLKYRQNVERISKIFKDRPMSPLDTAIYWVEYVIRYKGAPHLRSVGADLPWYQFYLVDVTIILLFGSILIIYILKYALRCIDSNQKHKFE

SEQ ID NO: 7066 - protein, 265 aa, Egretta garzetta
MPNMVYIGGINCEQKKPLSKEFEAIVNASGEHGIVVFSLGSMVSEIPMKKATEIAEALGSVPQTVLWRYTGEVPPNLPKNVKLVKWLPQNDLLAHPKTRAFITHGGSHGVYEGICNAVPMVLMPLFGDQMDNAKRVESRGAGLTLNILKMTSKDISVALKAVINDKKYKENIKRLSDLHLDRPIPPLDLAVHWVEFVMRHKGAPHLRPAAHDLNWIQYHSLDVIAFLLAVVLLSLFISLKCCLFCCRRCCCKKGRTRKPIKSKSH

SEQ ID NO: 7067 - protein, 400 aa, Necator americanus
MEDAEKDVQFSSGVRVANSWTTSPMSSVYQPFLVMFPVCGKFTLLLGDFTIIHVTLALMMESSDEMDFIERTKSFIGHNIYNLVYPWMVPNKETQMFRDHWDPEFPDIMDLLRNCPLVMVNSNELYELPRPTLAKVVNIGGVGVQYKDAKPLQDEFKKIADTGKGMVIMSFGSVAQSELMPEHWKTALLNAFARFTDYEFIIRYASDDLKDRLPKNVHAYRWLPQADLLLHPSTKAFISHGGYNSLQESINSGVPLITVALFGDQFKNSKIAAKHGFAVNIKKATLDESSIVAALKEILSNDRYSKNVRRLSLMVKRKPVNSTHLLVKWTEFLAEFQTLDNLTPAGNNLNFFQYFSLDVIGTLFLLTLVVTYLIFKLLASIIRCILSRSRKERRIVWFVM

SEQ ID NO: 7068 - protein, 533 aa, Physeter catodon
MSLGLWLPGQVLRGLLLCLCVGRWAEAGKVLVVPMEGSHWLSMREAVRELHARGHQAVVLSPEVNMHIKAEDFFTMKTYAIPYTQDEFDYIVTGKTHLLFERIHFLTLFLETMASLKNVSLVFQRSCEQLFYTKDLIRHLNASSFDVVLTDPVYPCGAVLAKYLSIPAVFFLRSIPCDLDIEGTACPNPFSYVPRLLTMNSDHMTFFQRVKNVLYPLTLKYICQVSFTPYARIASDLLHREVSLVDIFGSASIWLFRGDFVMDYPRPIMPNMVFIGGINCANRKPLSREFEAYVNASGEHGIVVFSLGSMVSEIPEQKATEIADALGKIPQTVLWRYTGTPPPNLAKNTKLVKWLPQNDLLGHPKTRAFITHSGSHGVYEGICNGVPMVMMPLFGDQMDNAKRMETRGAGVTLNILEMSSEDLEKALKTVISDKSYKENIMRLSSLHKDRPMEPLDLAVFWVEFVMRHKGAPHLRPAAHDLTWYQYYSLDVIGFLLAVVLTVVFITFKGCAFAFRKCFRKKERVKKSHKSKAH

SEQ ID NO: 7069 - protein, 527 aa, Ancylostoma ceylanicum
MLRLLILLLMIYSTCSYKMVIFVLDLSNSQLLFNKRVAEALADAGHDITIALIVPQSDLDNSDIKIKSGIKTHVVNAPINLTRKAMEERMEEYVFKESDSKMFGRFSLQISMILDTCRATVENKELLPWLKREKFDLAFAHMFDVCTVGLVHAARIPSWIWLNSGSVIDYVANLVGIPLIPSYVPPIMMSAAGEMNFLQRTKSLIGHGLMKIFWKRLIADPETELFRTHVSPDFPNLMELAAKCPLVMANTNELYEAARPTLAKVVNIGGIGMEVKDSKPIPEHIAKIINAGDVTVLFSFGSVFAAYRMPIEVKKAFLETFRRFPRYQFLWRYEKDDIKDMLPPNVHLFKWLPQSDLLRHPKTKVFITHGGFNSIQEAIHSGVPVISIPLVGDQPKNAALAEHHGFGITLRKGEISVESVSRALEEIITNTKYRDAVKRLSKMMDHKPVSPTHLLVKWAEFAAEFQTLENLEPAGNKLNFFQYHSLDVIFFLAFILILIVVFSIVLTKHLLRRVIALIFKSKKQKTT

SEQ ID NO: 7070 - protein, 535 aa, Sus scrofa
MAMGFQAPLPMLAGLLLCLCVVVPWAEGGKVLVVPMEGSHWLSMRKAVQELHARGHQAVVLSPEVNMHIKAEDFFTVKSYATPYTQDEFDDLMVRHLHLLFEKANFLTMFWTTMVSLKKVFLMFERSCEELLNNKDLIRDLNATSGFDAVFTDPFLPCGPIVAQYLGLPAVFFLNGLPCQLDFQGTQCPNPLSYVPRPLSGNSDHMTFLERVKNMLVALSEGFLCSAVYSPYAPLASEVLQRDVTVQDLMSSASVWLIRNDFVNNYPRPIMPNTVFIGGINCASKTPLSQEFEAYVNASGEHGIVVFSLGSMVSEIPEQKAMEIADALGKIPQTVLWRYTGPAPPNLAKNTKLVKWLPQNDLLGHPKARAFITHSGSHGIYEGICNGVPMVMMPLFGDQMDNAKRMETRGAGVTLNVLEMTSKDLENALNTVIKDKSYKENIMRLSSLHKDRPIEPLDLAVFWVEFVMRHKGAPHLRPAAHDLTWYQYHSLDVIGFLLAVGLTVVFIAFKCCVFAYRKCFGKKGRVKKSHKSKTH

SEQ ID NO: 7071 - protein, 260 aa, Papilio polytes
MFQELESWMNSSKNGVIYMSFGSNVSNKGLSMKTKHILFNVLSNLPYDVLLKWDEEVLIRHTKNINIGKWFPQSDLLRKYLLQLYLLVNLCSKFCLFTDHPKVKLFITQGGLQSTDEAIAAGVPMVGVPMFVDQAYNTEQYERFNIGIKLDFNDLTEEVFKKAINKVIGDENVDLVHIFYTFYRYRNNIMQLRNIINDQPQSPLDKAIWWTEYVIRNKGAKHLRSPTANISWMKYLEIELVSTVTIILLIFFTCLILIAK

SEQ ID NO: 7072 - protein, 522 aa, Echinops telfairi
MAVSRAGLLCLLVTGPLLSEAAQILTLSLLGGSHYLLMDQVSQILQDHGHNVTMLQQDGISLISDFKKGNKPYQVISWLPPENYQEEFMNYFNFFVEEAFNGRSTFEDYLKLIESLATQCTHLLRRKDITDSLKNENFDLVVVEIFDYCPLLVVEKLGKPFVAILPSSFNTVDIGLPSPVSYVPIYYSLLTDRMDFWGRVKNLVKFFDFSKKQWQVHSQYDNIIREHFPEDSRPVLFDLVRKAELWFINSDFAFDFARPLLPNTVYVGGLMAKAVRPVPQDLENFIAKFGDSGFILVTLGSMLHNYQIQDILKEMNKAFAHRPQGVIWRYKTSEWPKDVQLAANVKLVDWLPQSDLLAHPSIRLFVTHGGQNSIMEAIQHGVPVVGIPLFGDQPENLVRVEAKHLGVTMSLKQLKAETLARKMKQVMEDKRYKSAAMAASIIRRSHPLSPSQRLVGWINHILQTGNGAHLKPFVFQQPWYEQYLLDVLLFLLGVALGSMWLCGKLLRVMASWLRGSQKLKQM

SEQ ID NO: 7073 - protein, 530 aa, Drosophila yakuba
MGRICSGTALGLLLIGLLLLFSANADEGVQSSRILAVFPFPGRSQYIFAEQFLKELAHRGHNVTVINTFGSDEAEPNFRVIGAKKIHEIMAAFGNADYNQAATQWKVLTMTTEFLNLLTTSVLDEPAVKNLLHSGEKFDLVIMETVQTEALFGLSQHFGAETIGISSYGTDTHIDELMGNLSPLSYNPMLLSSRTERMDIKDRLRNVLEACVMWLHKRVVHLPTQRDLYVKYFPTARKSLDEVLDSFSLMLLGQHFSLSYPRPYLPNMIEVGGLHLQQQRKVQPLAKELSEFVEQSEKGVIYFSMGSNIKSKDLPPATRKVLMETFASLPQRVLWKFEDDQLPEKPSNVFISKWFPQPDILAHPNVKLFITHGGLLSTIESIYFGKPVLGLPIFYDQHLNVQRAKQAGYGLSADIWSANATELTSLIQELLSNASYAAAAQTKSKLFRDQKETALERAIWWTEYVLRHKGAKHLRCASRDLDFIQFHGLDTWGLLIAVTFASILIVVVALKCLQRGLTYIIANRRKLKTQ

SEQ ID NO: 7074 - protein, 550 aa, Caenorhabditis remanei
MHVNKLLSFLSFSLLGFSSGKNILMFNPMFGFSHVKFVSFMADVIADHGHNVTLFQPFHNAMKNTEGLVKNKNIEIINYYPNHYDELVNLETQTFPMFWDSHLMNNPILQAFMMPRALAGEFERTSVQLLKDKQTLDELKNRNFDVMIVETFELTGFCEFSIKIIINIVQFSDIAHLLEIPAIPIMSSVRFPCFNDLFGQPSGLGYYPHIGSKMAPEAGFLDRLNDIYRNFFMYVMMHRMANIQNDYVENAIGRPVPNWKDLVSRSPIFITNSNPYLDYAVPTTAAIVHAGGITMDLKKMKHVGKLPEEYVPILDERESTVLISFGSVIRSFQMPENFKAGIIQMFESLPDVTFIWKYEKDDVEFQKRLPKNVHLKKWVPQPALLADERVKVFVTHGGLGSTMEVAYSGKPALMVPIFGDQPLNAYMLERHGGAIAYDKFDLADGYKLTKTLKDMVSNPKYFKNAKELLEVLSNQPIDPKLNLIKHLEFAMQFPNLRAQVPAINHVGIIAHYYLDAIAFLVFVGGLTVYIGFLILRKLPIRIIPNKAKND

SEQ ID NO: 7075 - protein, 530 aa, Dipodomys ordii
MAPVVLPALLPVCACLLLASGSAQAGKLLVVPMHGSHWLSMRSVVEKLIHRGHEVVAVVPEVIWQPGRSLNFTVKMYSTSHTRDNLDQKFKDFADAQWKTRDNNMFALATGSSKVFFDITFSRCKSLFNDKELIEYLRESSFDAVFLDPFDMCGLIVARYFSLPSVFFSRGAFCSNLEEGTQCPSPPSYGPRSFQGLSHTMTFRERVWNHISFLTEHLFCPIFFEKAIEAASEILQTPVTTYDLFSQVSIWLLRTDFVLDFPRPVMPNMVYVGGINCHRGKPLPKEFEAYINASGEHGIVVFSLGSMVAEIPEKKAMAIAEALGQIPQTVLWRYTGSRPSNLANNTILVKWLPQNDLLGHPKTRAFITHSGSHGIYEGICNGVPMVMMPLFGDQMDNAKRMETRGAGVTLNVLEMTSDDLANALKAVINDKSYKENIMRLSSLHKDRPIEPLDLAVFWVEYVMRHKGAPHLRPAAHDLTWYQYHSLDVIGFLLAIVLTVAFLIFKCCAFGCRKCFGKKGRVKKSHKTKAH

SEQ ID NO: 7076 - protein, 454 aa, Onthophagus taurus
MFKGMVKPLLNRGHEIDFVSFYPLNVKHKRYSDIDLSTCFSVFKNNITVLKSAIGDLGLLQDVMFKLNGYNLMDAVLKSPQLRELRNTTKKYDLILRHVFLSDPLEIYSHIFKAPSIGIITSFNLPWTSDLVGIPDSPAFIPSFNGPYGEKMTFIERAHNILIYTYQKYQYWSLQKRFTELVWKYFGRNMPTVEELIGKTSLIFCNSHYTIHQSRSMPPNFIEIGGVHIPEKNNFTLPKNLQLSVDSSKQGIIYFSFGSMVRSTSFNRKTLSTMFEALGKQPYKVFWKGVKEEIPDDLKIPDNIIFETWMPQLDILCNPNTKLFISHGGLFGVQEAIYCGLPILGIPFFADQASNIQFLVEKNVAKLIYVDDIPEGNLFKEYVETLLKPQFKQNAENLSKLFRDRPMSPIKTAIYWIEYVIKHNGAPHLKSFQLIKLALKVKGIQYICNSKKRK

SEQ ID NO: 7077 - protein, 521 aa, Helicoverpa armigera
MSVSVLNIFVVCGLFISSNEAARILAVFPVPSISHQVVFRPLTQELARRGHEVTVITPDPVFPNGGAPPNLTEIDVHDVSYNIWKESFIKAASKGVKDDSYSQMEIIMSTFSRVFDAQLKTDVVQNLIKDKSKQFDLLLLEACVRPALAFSHIYKNVPVILVSSLGAAPGNYEVIGASEHPILYPNLFRKRLYNLSFWEKIGELYEHYRIVKFFESNTVLENQVLRDNFGREIPTVHELGNNVDMLFLNINPVFEGIRPVPPSVVYMGGLHQKPAKELPTDLKTYLDSSKNGVIYISFGTNVAPSMLPPERIQILVKVFSQLPYDVLWKWDKDELPGRSKNIRISKWLPQSDLLRHPKVKLFITQGGLQSTDEAITAGVPLIGVPMLADQWFNVEKYVYLKIGLQLDLETLTEEQFRNAINTIVGDDSYKRNIEKLRSVMEDQPMKPLERAVWWTEHVLRHGGARHLRSPAANMSWAEYLELELVLIVLAGLLAILTAIFGAIYALCRCFTKEVSVKHKSH

SEQ ID NO: 7078 - protein, 522 aa, Bombus impatiens
MKHQKALFCVLLALFIHANDASRILGIFPYNGKSHFRMFDVLCKELVKRGHQVDVISHFPLKTPLANYTDVVDLNGTLKTVVNGITTDYGKYIQRSVTYFVATDFGNNLCDLMKQEKMQKFIKNPPNDPPYDLIIVEYFGSPCYIGFGQLLKAPVAIVMSSMQMSFIDDIMGNPTSYAFFSGFYNDNAVVNTFFDRLWNFLINYKNTLIFHHYTAEQTDMMKKYLGLPNIPDVRELEKTVSLAIVNSHYSYYGIRPVTPAVIEVGGLHVEADKSKLSPKLKEWLDMASHGVVYFSLGSLMNVETLPTETILQIYASLAKISPVKVLLKSANATKLPPGLPNNVLTLPWIPQVAVLKHPNTRVFVTHGGLMGTQEASYYGVPMIGMPVFGDQIKNINVLVEKNVAVLVDIDDITEHSMDAALNAVLHDPRYRESAKTLSKMFRDRPMSPLDTAVYWIEYVLRNGPDSLRSAAVKLPWWKLHLLDVFVFLFACFTFAIYLLIVSLNIVLTSFHKRAARTEKKLN

SEQ ID NO: 7079 - protein, 506 aa, Strigamia maritima
MYILNAQLLKLSLVLLFGCENLYCYNIIHIFPFAPRSHKNVFDPLITELAKRGHNVTIVTSYKNSHPEKNINEIFIEHSSSFENSKFQQDLFSSVNRHPLATMSLFKKIFLPMCTGYLQHPKIKQLLNEGKQYDIVILNAFLNECTLATAPLLGKNIITQSPASLCTWCSTASVPQPPSYVPSLIFPYTSNMNFLQRLNNAVTIQGLQLLYKYQVLSSLQTEVAKHLPDNPSITEASKLVSLFLTNCDPVLISPRQQMPYVVNVGGMHCQKAKPLPKDLEDFVQSSGESGFIYFSLGSNAQSRYLPDNVKKSLLDTFSKVKQKVVWKYEEELVNGPSNVKIVKWAPQQDLLGHSKIQLFITHGGLLSMQESVYHAVPVVAVPLFGDQGSNVARVQELEIGVKVDFHNISGSCMLDAVNTFLLYLQIQKNMLKYSALFRDRPVEPVEEAASWVEYTVKHNGAWHLKSSADDLNFFQYFLLDIMTFILIIFISAVCLLAKFARFLAKL

SEQ ID NO: 7080 - protein, 505 aa, Mus musculus
MAAHRSWLLVSFFLLEVLLLEAAKILTISTLSASHYILMNRVSQILQGGGHDVIKLLYEGGDIPDFRKENSSYQVINWRLPEDQQKTFENRWHRLIDEYAYGSHLLSRKDIMELLQKENFDLVLLDSMDLCSFLIVEKLGKRFVSFLPFQFSYMDFGLPNAPLSYAPVYGSGLTDQMDFWGRVKNILMFFHFTKKRRDIFSQYGNTVQEHFAEGSQPVLSDLLLKAELWFVNSDFALDFARPLFPNTVYVGGLLDKPVQPIPQDLEDFISQFGDSGFVLVALGSVVSMIQSKEIIKEMNSAFAHLPQGVLWTCKSSHWPKDVSLAPNVKIMDWLPQIDLLAHPSIRLFVTHGGMNSVMEAVHHGVPMVGIPFFGDQPENMVRVEAKNLGVSIQLQTLKAESFLLTMKEVIEDQRYKTAAMASKVIRQSHPLTPAQRLVGWIDHILQTGGAAHLKPYAFQQPWHEQYMLDVFLFLLGLTLGTLWLSVKVLVAVTRYLSISRKVKQA

SEQ ID NO: 7081 - protein, 529 aa, Galeopterus variegatus
MAPALVTGPLLLCVCLLLTGGLAEAGKLLVVPMDGSHWFTMRPVVERLMHRGHDLVLVTPEVSWQLGKLSNYTVKTYSISYTLKDLDREFMVFANSQWKTRGQSLFSILTSSYNTIFELLFSHCRSLFNDRKLIEYLKESSFDAVFLDSFDMCGLIVAKYFSLPSVVFARGIYCHYLEEGAQSPSPLSYIPRGFSGFSDVMTFKERVWNHIFHLEEQFFCPIFLKSALDVASEILQTPVTASDLFSHTSIWLLRTDFVLDYPRPVMPNMFFVGGINCNPCSPLPQEFEAYVNASGEHGIVVFSLGSMVSEIPEKKAMAIADALGKIPQTVLWRYTGPRPSNLANNTILVKWLPQNDLLGHPKTRAFITHSGSHGIYEGICNGVPMVMMPLFGDQMDNAKRMETKGAGVTLNVLEMTSEDLENALKAVINDKSYKENIMHLSSLHKDRPIEPLDLAVFWIEFVMRHKGAPHLRPAAHDLTWYQYHSLDVIGFLLAIVLTVAFIAFKCCAYGCRKCFGKKGRVKARKSKAQ

SEQ ID NO: 7082 - protein, 219 aa, Homo sapiens
HLLCHRFFKNALEIASEILQTPVTEYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQ

SEQ ID NO: 7083 - protein, 220 aa, Papilio machaon
MFDFEDKQNKVLKRIFGPDVPTMNELKNEVEMLFLNINPIWEGNYPVPPAVVHMGGLHQKPPKALPKDLSQLLDDSSNGVIYFSFGTNVRPSLLDPAKIDMFHKVFAELPYNVIWKWDDESLKPRSDNVRIFKWLPQSDLLRHPNIKLFITQGGLQSTDEAITAGVPLVGIPMLGDQWYNVEKYVYHKIGVRLDFEELTEEKLKKALLDVAGNERLVLPN

SEQ ID NO: 7084 - protein, 533 aa, Aethina tumida
MAMKVISILCALLTVSQCSNILFVTIFPNPSRQALFQPIWKELSLRGHNVVVITPNPLRDEKLTNLTEIDISKIYNLLWKYDDEDVEELRYHLTLPIGLSTLVTRNAKMTKLFNNIHKMVFDLPNVQDFLRKSMDFDVVITESLYPTLTAFGPKYNAPLIGLTSSGAPIPGLDTVGNPTHPINSPYHNFPVGRDMSIKEIILFTIWAVYLKINYYFIVLPREDALARKHLGNHLPYLGNVEFNLIIRNKNPIFPKSMPILEPVVVELGYMQKNVSELDDKMKEFLDQSKNGVVYFSLGSNIKPSVLPPKYIKEIVGAFRKLSYDVIFKWDQDILEDMPKNVLISKWVPQEAVLRHNKTVVFVTQGGVQSCEEAIINEVPIIGIPFFPDQISIVDTMVEYGVGKRMNYAELTAYQLSVLIEVVIENPIYKENIINLKKLYTDQQTDGLDERIWWIEYVIIRHKGASHLKNSGKDVYWYQKLLSDMFSFGSFLFVGVCMVSAYYLLYVMAKHNLLLIFYLLRKFREGVRYARTLP

SEQ ID NO: 7085 - protein, 543 aa, Megachile rotundata
MKLCSIVLFCAILSICHGYRILCLFPFNGKSHFIMFEQLMKALARKGHQVDAVSPFPLKKPYPNYRDALTVPVSRQFMNNMTFAEVNEMINSSPAYAVGSILSDEVCRYLGNEQMQQFLKNARKNPTYDVVIMEIFGAHCFAAVGHVLNVPIIGVSSSALYPWAYEYIANPENLAFAPNILLSYMENMNFFQRLYNFLHHKYNVHVFRQASSIQTEMIRKYVSPDLPDIRELEKKLAMILVNSHSSWNGIRPSTPALIEVGGLHVQEEGVELPPSLEKWMNESKDGFIYFSFGSMVKIESFPAKYLKIFYSSLGKIAPVRVLMKIAKSEELPPGLPKNVHTLSWIPQVKVLKHPNIKAFITHGGLMGTQEAIHYGVPMIGIPLFADQFINIDVGTVKNITIGLNLDTLTEERMDEALNAVLNDPKYRNAAKKLSERFLDRPLNASETAVYWVEYIAKHGADALRSPAVDLAWWQRELLDVYAFLLVALLISLYALTVVVRFVFQLVNANDSAAHKKKDEYNATYIVINGSVHSKNISKQSGNR

SEQ ID NO: 7086 - protein, 1051 aa, Zootermopsis nevadensis
MFSCTVTDHPKVRVFLGHGGLLGTIEAVHVGVAMIGIPMYGDQGTNMKMVEAAGMAVILQYKDITKDSVLQALRTILDNSSYTENAKRTSRVFRDRPMSPMDTAIYWTEYVIRHHGAPHMRTAGADLPLHFMMSEVLMKGLAARGHEVTVISHFPQKTQVANFTDISLIGSMPSFVSTVPLDDIATGWVYTTVKIVSELGVTGCEKTLSHPPVQKLMNSKEKFDLVITELFNTDCYVGFAYKFKVPFISIVTTPLLPWGYERFANPDNPAYIGNIFLGHSDRMSFLERLVNTVYMKILQWEYHYWFDMPSQMIARKYFGETLPPLADIVRNTSLVLVNRHFTLNQPVPNVPAVIEVGGLHVEVPKKLPEDIDKYLNESEHGAIFFSLGSTVRADTFSQQKIDAFLQAFSVLPQRVLWKWEGEALPEHPKNIKIAKWLPQADVLGHPNVKVFITHGGLMGTMEAVFNGVPMVAIPLFGDQFHNVRNYEEEGVAIKLDYSTITKEKVLRALKEVLNNPSYKQNAVTLSRAFRDRPMSPLNTAIFWTEYVIRHGGASHMRSAALYLTWYSYKILCLFPHTAKSHFFMAEALMKGLAAKGHQVTMISHFPQKTPIPNYRDISLVGSMPEYVNQVPLDTVATGHVYTTISFLAHIGYDNCKNTMEFPAMKKFVAANEKFDLIVTELFNTDCLLGYVYRQHTPFIALSSSVMMPWAYARFGNPDNPSYMGNHFLYHGNRMTFPERVINVLYQEGLKLVYKFVFDRPANELAKKYFGESLPPLSEIAKNTSLLLVNSHFSLNQPRPLLPNIVEVGGIHLQPPEHKLSKDLKEFIDGAKHGVVIFSLGSSVKADTFPPDKRDAFVQAFSELPQRVLWKWEGDTLPGQPKNVKIVKWLPQMDVLGHPNVRLFVTHGGLMGTTEAAYSGVPMVGIPLFGDQFHNVRSYVLQGIAVTLDYHTISKSTVLSSLKEVLENPSYKENALRIQKALNDRPLSPLDTAIFWTEYAVRHGGAPHLRSAAIELAWYQYLLLDVIAVLFLAVAVVMAVFYFIVKKLFSLC

SEQ ID NO: 7087 - protein, 542 aa, Neodiprion lecontei
MKSCSAKLLCLFVIVTGCVVSSCECDEIRERFNILGVFGHLGKSHFDVFLPILEELAHRGHNVTVLSFFPRKDRIPNYRDISLGDSTAIFLNVIDLTKLDHSIFYIVSELKMLHNMAEIACYSALRTTAVKEFLKSDEKFDLILTESFNTDCFLGFVHKFKAPFIGLSSHAIIPWVNNRLNNPDNPSYIPGLFHSVSPSMTFFERVMNTFWIVAEQIAYDLMFTRPMQSLVEETFGPGVPPLQDIANNMTALMVNTHFSLHGARPLSPSVVEIGGVHIRGAKPLPKDLQDFLDSAEHGVLYFSWGSMVRASSMPNETLATIVEALGRLKQKVLWKWENDDLPNKPKNLMTRQWLPQFDVLSHPNVKGFLAHAGLLGLSEAIYVGVPIVAVPMFGDQHGNAKAAEARGAAIILQYEDITVDTLTGALNEILNNPSYRRNARAVSEAYRDRPASALETAVWWAEYVARGKGRPFLRSASANLSWYQYHLLDVIGFLSLAGLAVLFVAVFAVKRLLKALNLPVKKVGITSEANDLTKNETNKKRN

SEQ ID NO: 7088 - protein, 529 aa, Caenorhabditis elegans
MRYLLLLAFFPVAFGFNYLIISPVFGYSHMKFMGRIADILADAGHNVTLFQPIIYDYYAHKKIVKNPNIEVINYEVDEEEKAAASEASVFKFFWKAKGSKNPISSAKITSEKLYKEFEHICRKMLLDKELHRWILSKNFDSHISEAFDFCGLYLGDFLKLKSPIPLYSGVRCGAASYAVGEPIPLNYLPTEGSNYGKKSSAIDRLSDMLGLTGYHFQFGILFDKQYDQAYRLTGGNVRTWQEILQSSTFFLTNSNPYLSFSTPTISKVIQIGGFTIESFKTTTLDEEFNKILSLRNNTILVSFGTVIQSSDMPDDFKTGLIEAFRRMPDATFIWKYEEDDKTLKNKLSENVVLSKWIPQPALLADSRLDLFVTHGGLGSTMEVGYAGVSSIMVPVFSDQGVNAEMLARHGGAIVYDKFDLVDSKKLMETIQMILNNSDYRKNSKRLSDILHNQPMDPKQVLLNHCEFAARFAQVDNLEPYANKYNFIEFYCLDSLALVVCTISVVALVMFKILSFVVNSVIEKLKLKKE

SEQ ID NO: 7089 - protein, 309 aa, Tupaia chinensis
MVYTPYAQLASEFLQRDVTVQDLLSSASVWLIRNDFVLNFPKPIMPNMVFIGGINCMSKAPLSQEFEGYINASGEHGIVVFSLGSMVSEIPEKKAMEIAEALGKIPQTVLWRYTGSRPSNLAKNTILVKWLPQNDLLAHPKTRAFITHSGSHGIYEGICNGVPMVMLPLFGDQMDNAKRMETKGAGVTLNVLEMTSEDLANALKTVIFDKSYKENIMRLSSLHKDRPIEPLDLAVFWVEFVMRHKGAPHLRPAAHDLTWYQYHSLDVMGFLLAIALTVAFVTFKICACGFRKCFGKKGRAKKSHKSKAH

SEQ ID NO: 7090 - protein, 1049 aa, Ostrinia furnacalis
MARLISLVILIACAFVSDEGARILAVFPTPSISHQVVFRTLTLELVNRGHEVIVLTTDPIFKDGGSPKNLLEIDAHDVSYDSWSVFTSSNLTTGNKKDTRAQSRLILTLLMSLFEKQMQLDDMKQLLMDKSQKFDLLILEAYFWPLLGLTHVFKAPVIQVSSFGSTDDNLKTFGAVIHPFLYPTCGIQRVNNLTFWEKVSNIYNAYITERNLAKLYEISNEMLKRVFGESVPSIDDLRNNVDLLLLNIHPIWERNRPVPPNVIFMGGVHQKPEKELTQDLKKYLDASENGVIYISFGTNVDPASLPPEKIQSMIAAVSKSPYDVLWKWNHDELPGRTSNIKISKWFPQSDLLRHPKVKLFITQGGLQSTDEAITAGVPLIGIPMFGDQWFNIEQYEYHNIGIKIDMDTISEEKLRNAIETIMKDKSYYDNIARLRTLMYDQPQSPLERAMWWTEHVIRHSGARHLRTAAANMSWQQYLEIELVIYVILGFITVILSIIFACYLLYRTVIRLSKSTKLKRTYQVCCVISMTSFRHVFTIACFIAHNEASRILAVFPTPSISHQVVFRPLVEELVKRGHEVVVVTTDPVYKNGGAPTNLTEIDVHDLSYGIWRTEFLQASVASGSKEELSGQVSMSLKTMMKVFEEQMLTTEFQKLLKYKSQKFDLLLLEAFFTPLLALSHVFKAPVIQVSSLGNTEDNLHMVGAVSHPILYPTAMQQTLNHISLFEKLSEIYHYYDTLAILAAVEKFYDERIAAVFGTETPPLTELKNNVDMLFVNIHPIWENNRPVPPNVIYMGGLHQKPEKELPQDLKNYLDSSKNGVIYISFGTNVDPALLPPEKIQTMINVLSKLPYDILWKWNQDELPGRTPNIRISKWLPQSDLLRHPKVKLFITQGGLQSTDEAITAGVPLIGMPMLGDQWFNVEQYVHYNIGIRVDMDTVSEDKLSSAIQTILKDNKSYRQNIVHLRSIMRDQPQSPLERAVWWTEHVLRHSGARHLRAAAANLPLYQYLELELVTYVVLALLTVVTLTLVTLYSLYSLVSKKFVRQKVKSS

SEQ ID NO: 7091 - protein, 2225 aa, Blattella germanica
MYHNKKLHIRDSFSINHNCRPSNLTCYLRNKNQLENLIAIFKISVPNLVNIRSSHLGTKSIVDQCYLIEALQLEHNHRKMFYNEDIFQDTISKLSMFVLSDFRYPSYQCLFCQISDIQVDSLFYSMTEHIQGAKILAIFNLNVKSHFFMFETLLKRLAERGHQVYVAGHFPLNKPIRNYVDISVEGSVPALFNNFTIEYGRSLGYWNLWHFIFIHTVEMCETMLQQPQMQEIISGEHKFDLVITEPFGPDCFAGLAHKYNAPLINILSSVALPWVNDRIGNPDNPSYIPNYFLPYSDKMNFFQRVINLMFTEGLKLGEYYFGELAMDELGRKYYGADLPPLSTLKKRTSMLFLNSHFSLNIPRPVVPSFIEVGGLHIRPGGKLPKDIETFMNEAKRGVIYFSLGSLYFISGHPNIELFITHGGLMGVQEGVYAGVPMIGIPLFADQQHNIENCVSKGMAEMVDYDFLSEETMMNALSTVLNNTSYKTNAKQLSTLFKDRPQTALETAIFWTEYVIRHKGAPHLKSAAVDLPFHQYLLLDVLAVILLGVCVTALLLFLIIYKIYTQAKEIKIKLRISTIQGRFSTTEALIKFIGQFGRIAIFKIDRFMKHFHIILTGLLITMSCVDHMDSYKILGLVHLNSRSHFVMFEALFKGLAAKGHEVYVISHFPQKEQIPNYKDISLAGSVPLSVNNFTMDFVKDFGYFNLLDYLWHNIVDMCDKSLGHPSFQKLLSSNDKFDLIITEITVFLFLTQKFNAPAISMTTSVTFPWGNDRFANPENPSYIPNYFVGFCRMNFVERLICTVSLVYAKLGHYYIGETNMEKVFQKHFGNTVPPLSEQKKNTSLILELETFINEAENGVIYFSLGSLVRGESLPKDKLQIFIDVFKHLPQRVVWKIDTIQGLPKNIWTSKWMPQLEILNHSNVRAFISHGGLMGTMEAVHIGVPLVGIPLFADQTLNVKNCVSKGFAIMLDYDLLSKEALSKALNDVLHDPRMKAKNSFHLHQNKHFNQNCYFHILELPMQWLGIILTGVIILSSVDRTTCYKILGLVHLNSMSHFVMQEALYKGLAAKGHEVYVVSHFPQKESIPNYTDISLKGSLPDLVNNFTIESLRNFGIINLCKYIWYTLADMCDTALGHPSFQKLLYSNITFDLIVTEIVGPDCFLFLSRIFKAPVISVTTSVAFPWGNDRFGNPDNPSYIPNYFVPFTHQMSFKERVINTVILATAKLGNYYIGEANMEKVLKKHFGNTFPPLSEQKKDTSLVLVNSHFSLNFPRPSVPAFIEVGGLHIQPGGKLPQDLQTFIENAEHGVVYFCFGSLAQAESLPKEKLQVFIDVFKELPQRVIWKIDNVRDLPSNIWTSKWMPQLEILKCIIFCIVLEHPNVRAFITHGGLMGTQEAVHAGVPMIGIPLFADQELNIRNFVSKGIAILIEYDSLSKERLSEALNAVIHDPSHFSISTPRPMVPTSIEVGGLHLGTPKKLPKDLERYINESTHGVIYFSLGSLVRSETFSSEEIKAFADAFAELPQRVIWKTDTIPGLPKNVLAAKWLPQFDILSHPNVRVFITHGGLMGTQEAVYNGVPMVGIPFYADQHHNIENYESKGIAVKLDYNHISKESVLSVLKTILNNPRYHENAKRISNLFKDRPQTPLETAIYWTEYVIRQRGAPHMRTAAADLPWYQYFLIDVILTLVVAFFLPLLSLYLICKRTMKFLGFTIATSLAFIFLAGTTEAARILALFQFNGKSHFVMFEALLKGLAAKGHDVVVVSHFPQKNPVQNYTDISVEEALTEAVNSFTLDFALNFRYYNLLYFFWQENLEFCEAVFEHPNIKRLIKSEEKFDLVITELFGVDCFTGFAHKFQAPLISMTSSTLLPWANDRMGNPDNPSYIPNYFLSFTDRMTFPERMLNTIFSIGLKWGSYYFSELPTERLARRYLGEDLPPLNEIAKNTSLIFVNSHFSLSTPRPLVPGVVEVGGLHIRTPGKLPQKLQKFIDDAKDGVIFFSLGSLVKGETLPEDKRQAFLSVFSKLPQRIVWKADFMPGLPDNVMTGTWLPQFEILNHPNIRLFITHGGLMGTQEAIYIGVPMIGIPLFSDQKMNIENYVRKGIALKLDFYSITEETLLSSLNTILNDPSYEKNAKRMAALFRDRPQSALETAVFWTEYVIRHQGAFHLRTAAVDMPWYQYLLLDVIATLLLIIILAFVMIYYILKKITSLIFGRKPSSSMNGHLQKSKKH

SEQ ID NO: 7092 - protein, 519 aa, Helicoverpa armigera
MATLNYLSLCLTLQLIFYTDAARILAVYPVPSISHQVTFRPITLELVKRGHEVVVVTADPMFKKGEAPQNLTEIDVHDLSYNVWEAFMNSERGKKEDLIPQMRVGVEVLVELFDKQMQVEEVKELRKGKQHFDLLLTEAVVKEALAFSHIYKVPVIQVSSFGAMFENYKVLGAPVHPFLYPESMAMRIYNLTMYEKLNELYVKYTVEYLFASIEERQNVLMKKYFGDDLPSMQELQNNVDMLFLNVNPIWEGSRPVPPSVIHLGGLPQKPNKELPKDLKSYLDSSKHGVIYISFGTNVKPSLLPAEKIQMLVNAFSKMPYDVLWKWDKDVLPGKSDNIRISKWLPQSDLLKHPKLKLFVTQGGLQSTDEAITAGVPLVGVPMLGDQWYNTEKYEHHGIGVKLELGTLTEELFANAVNKVIGDESYRKNINKLRELMNDQPMKPLERGIWWIEHVLRHKGAKHLRSPAANISWSEYLELELVFTVLAVALSALLILAFALYSLYKFVSNNFIIKAKLKST

SEQ ID NO: 7093 - protein, 243 aa, Trichoplax adhaerens
YPRPVTPATKVVGPILPKPAKALPIHLQEFVSANPNGTIVMSFGSVVTGLKYITDVQMLFKSLGRLPYNVICKYSEKHKYSIPKNVMTFNWLPQNDLLGHPNIKGFVTHCGMNSILEAAYHGIPMVGIPIFGDQIVNAQKILYRNIGVVLDINEINSDDLYFGIMNATTDQWILGNASIVSKLIKNRPNGRTPVEEAADWIEFALNSKGGHYLRSEEYNLPWYQLYLFDIFAILCMMIIITII

SEQ ID NO: 7094 - protein, 456 aa, Copidosoma floridanum
MMFNALMVGLAKRNHQVDVITHFPAKNPPPNFKLLIKLNGTFDKVSINSVVDRDLTAHIADLRGNKMCELLGIEEIQKLIKNPPHDPPYDLLVTEVFGANCFLGLGYVLNVPVVAVTTSVEYPWVADFNGNHDNLAVVPSYYTTNFDKFKFSHRLFNFLMRKYLSPDIPNIREVEKSIALLIVNRSPLIDGPKPVTPSMIEVSGLHLEENEIPPITPELQKWLNESEDGVVCFSFGSMVLIETLPLNSIKALFESFKKISPVRILMKIVDESKLPPGLPENVKTLPLIPQQAVLAHKNVRIFLTHGGLMGCQEALYFGVPMIGVPLFSDQPQNLDKFVAMNMAIKINYNNLTTTSLDEALNAVLYDPKYRENAKYYAKVFKDRPMKSMDMATFWIEYVIRNGNIMKSPALELSWWQLTLLDVYGFLLTCLAIAFTVLYRVTRRLMKKVPVLLAQWS

SEQ ID NO: 7095 - protein, 390 aa, Trichoplax adhaerens
SFLDAILCDPIFYACQVVAEYADIPIQIDVSPLGIGEPFTSLHHIPSPPAYIPQYSLASKMNLIERTANVIINLILLPALNHLIFKPIYAVTNASKLGLKTIPRYEVRRASFLIANGDFAIDYPQPLTPSSKLVGPILAKPAQSLPTDLERFITSNPKGAIVVSFGTVVTALKHIVDMQIFFYAFRRLPYNVIWKYDEELPDEVASRNLKLVQWLPQNDLLGHPQVKAFVTHCGYNGILEAGYHGVPMVGIPIAGDQIAHANKITARTIGVILNIRTLASDDLYNAVMKVTSDQDILGNASKVSKIIKNRPNGRKPVEEAGDWVEYALNCNGGDYLRTEEYNLKWYEFYLLDVFAVMIAICYLIVKVLRLLWNGMVMLCSDNKKAKVKAS

SEQ ID NO: 7096 - protein, 520 aa, Vanessa tameamea
MRPPLIYYVVFFTLSSYAVHGARILGLFPHTGKSHQMVFEPLLRKLAERGHHVTVASFFPLKNPPANYTDVSFEGIAGVGIETFDLNWYENPSLVQRIPIVGSVVKQINEFNPLAGMAIHVCSKVVDWPPLKEALSKEYDLVLLENFNSDCMLGLLHVYGIKAPVVALLSCTLMPWSAYRIGITDNPSYIPIVSTAFNSQMTLLERMENTFLKIYYKLWFNHKIQLKEQAIIEKQFGRKIPELSELSKNVTLMLTNTHHALNGPRPLLPGLVEVGGMHLDPTRKVIPEHIEKFLNDSENGVVLFSFGSLIKTASMPKYKEEIFINALSKLKQRVIWKYEDSAENGTLVGNILKVRWLPQYELLRHNKVVAFIAHGGLLGMTEAVSAGKPMVVIPFFGDQPGNGASAMAAGFAKVVSYMDLTEQELSEALQSVLSAERRLNARRVSNMWHDRESAPLDTAVFWTERVIRWGHTGKLHSSAKNMPFYEYALLDVAAAYTLILIVIITVIYYKNPAISSCIRF

SEQ ID NO: 7097 - protein, 535 aa, Caenorhabditis remanei
MNVKFLISVSLLVLFNSTDASKILIFNPIFGFSHVKFISKLADIIAEHGHNVTLFQPYHNAMKNVEGLVKNKNIEILNYYPTHYDELLKKETQTFSIFWDSQLIGNPVLGAFMLPFVLGGEFKKTSMEVLGDKNLINDLKERRFDVVMAETFELTGIYLAHLLDVPCIPMMSTVRYPIFNGLFGQPSFLGTVPQQGSLGAPEAGFLDRLNDIYRFIFTGIAQERLNKYQNDFIQEAIGRPVPNWKDLVSQSPIFITNSNPYLDYAVPTTAAIVHVGGITMNLDKMKNTGKLPEEYENILKERESTILLSFGSVIRSYEMPENFKAGIIQMFESLPDVTFIWKYEKDDVEFQKRLPKNVHLRKWVPQPALLADERVKVFVTHGGLGSIMEVAYSGKPAIVVPIFGDQSHNAMMLARHGGAVAYDKFDLQYGQKLAGVITELISNPKYKENAKMLLEVLVNQPIDPKINFLNHLDFAIKFPALRSQVPAIQHVGWIAHYYLDALVFLFILAIIFLYLLFKLLRRLLNRFIGKKPKNE

SEQ ID NO: 7098 - protein, 474 aa, Bombyx mori
KAGHELTYITPYPKTPAPNLRVIQIAEHAFEEKMNSMFTIEKLIDNTFALKEMFSILKSFIDTANDTVSNTEVQQLMLDPQTHFDVVIAEWMLTEIFSGFSTIFNCPLIWSSSMEPHSPILQLIDEMVHPAYSSNMLGLFEPPYNFFQRAINTLIEIGLKVAKWFSALIEEQIYKEAFAAAFKAKDLVQPSLEELRYSAALVLGNSHVSSGAPLKLPQNYKAIGGYHIDEQSKPLPKEFKNILDNSKHGVIYFSLGSIVPSKSMPAEIKNGLFEMFRNLKYTVIWKFEDEFQNVPDNVHIVKWAPQQSILAHPNCILFITHGGLLSTTETLHHGVPIIGMPIFGDQAMNVKKAVHKGIGLEVKFDSDTPKNLKAAINEVLSNQKYRDRVKELSLIYHDRPVSPGAELVHWVEHVVQTKGALHLRSPALHVPLYQKLLLDIIFVSLLLFLGFVFFVKFMLTRYLKKKTDIRKKTL

SEQ ID NO: 7099 - protein, 421 aa, Spodoptera litura
MSTAVTLFLLSVSIAYNDAARILAMFPVPSISHQVVFRPYTQELARRGHQVTVITPDPAFPKGEVPANLTEIDVHDFSYEMWKSFYKVTSTGDNDLILQMTLAFSIIVDIVEMQLKLDVVQKILKEEKFDLLLLEACAKPALVLSHVYKVPVIQVSSFGPMNFNVETIGSAWHPLLYPGILTKRSLNLSKWEKLEELWNFYRIEKILKGVENSENEMAERLFGPDVPSMSELKNNVDMLFLNAHPIWDGNRPVPPSVIYMGGLHQKPQKELPADLKRYLDSSKNGVVYISFGTNVQPSLLPQDRVQMMAKVFSQLPYDVLWKWDKDELPGRSKNIKISKWLPQSDLLRHPKIKLFITQGGLQSTDEAITAGVPLIGFPMLGDQWYNVEKYVHHGIGLQLDLLSTNEVEFKNAISTVINDER

SEQ ID NO: 7100 - protein, 1066 aa, Spodoptera litura
MEKIICLLFCTVVTLCSCEAYKILAVLPIPSPSHGILGDNLVRHLLDAGHEVTYVTPFTSKQKNHTNLHIVDVDANHVIYEDGEDQLDFQQILDHRSTVVDSPFLFWVLSNVADMTLSNPNVQKLLRDPQQKFDVILVEYIFTDVFSALSAIYQCPFIWFSTIGPHWMVLNLVHGPLNPAYNTDFLQARVPPFPFLGRVEELWTQVKGLYRHKFDFYYEEERIYQNRIVPILQELGKPVLNLNTMKYNASLLFGNSQVALGDAVPLPPNYKHIGGFHVDEVAKALPENLQKIMDEAEYGVIYFSMGSNLKSKTMPNELKKGLLKVFGGLKQTVLWKFEENLSDRPKNVHILQWAPQQSILAHPNAVLFVTHGGLLSLTEAVYFGVPVIVIPVFSDQFLNANQAQHKGIGEQIKLSYNLDKDLKVTLNKVLGDLSKYTARAKKVSAAYRDNPVKPGKEFNFWVEHVVRTRGAPHLRSVALQVPLYQQAYLDLFAVLLAAAVVIVLVVKKIVCFLTSKSKKLKRNIVIRQRIFQKDLKLIETFSKMEKLRYLLFFVVLSLCTCDAYKILVVFSNPNPSHGILGDNMVKHLLSAGHEVTYITPYIETLKNKTKAHLVDVGNTHKILEVAKDIMDLKQILEGTVESPDFKLMFELVSTIGDMTLSNANVQKLLRDPKQKFDVIIAEFMFNELFSTFSAVYQCPYIWFSTIEPNWIALHLVSDPMNPAYNSDYLHGRIPPFSFKERVEELWTQIKGLYHYNFDFYNAEEAIYQKHVVPVLKEQGKPVPDYNMLKYNASLMLGNTNVAIGNAMPLPPSYKHIGGYHIDEEVKPLPEDLKKIMDNANNGVIYFSMGSNLKSKELPDELKNGLLEVLGGLQQTVLWKFEENLPNKPKNVHIVQWAPQQSILAHHNLKLFVTHGGLLSLTEAVHFGVPLIVIPVFADQFLNANQARNKGFAERVDLSYNLDKNLKVALDKVLGDFSKYSARAKEVSAAYHDNPMKPGVALNFWVEHVVRTRGAPHLRSVALQVPLYQQAYLDLLAVILAATVVILLVVRKIISLLTVKNTKLKKN

SEQ ID NO: 7101 - protein, 520 aa, Helicoverpa armigera
MSLPVLYLLVTCMLISSNEAAKILAVFPVPSISHQVVFRPLTQELAKRGHEVTVITPDPVFKKGEVPSNLTELDVHDISYNIWNENFIKAASKGNKEDMYTQLEIILDTLVEVFEAQLKTDEVKTLIDDKSKKFDLLLVEACVRPALAFSYVYKNVPVILVSSLGAAPLNYELIGAADHPILYPSVLRQRLHNLTTWEKFTELYSHYRIMKIYENNAVLTNKVFRDRFGPDIPTVDELGNNVDLLLLNVHQIFEGIRPVPPSVVYMGGLHQKPIKELPKDLKTYLDSSKNGVIYISFGTNVAPSMLPPERIQILVKVFSQLPYDVLWKWDKDELPGRSKNIRISKWLPQSDLLRHPKVKLFITQGGLQSTDEAITAGVPLIGVPMLADQWFNVEKYVYLKIGLQLDLETLTEEQFRNAINTIVGDDSYKRNIEKLRSVMEDQPMKPLERAVWWTEHVLRHGGARHLRSPAANMSWAEYLELELVLIVLAGLLAILTAIFGAIYALCRCFTKEVSVKHKSH

SEQ ID NO: 7102 - protein, 537 aa, Papilio polytes
MRLPLRFLHSSVSVLVIMLVKVLHILLLNFIVSVKSANILAYYPCPSISHQVVFRPITLELIKRGHTVTVLTTDPIYPRGKTPANLTEIDMHDVSYNLLRKNLHRIIIGKTNEVITQVHNIKELSIIAIEEQMNITEVKEFISDKKQRIDLILVEAFLETALGISHLFKAPTILVSSFGPFLGNYEIIGAPTNPPYLYRNFFSQKLYNMTIWEKIIDLYTQVRIKYITIASEDEENKALKRIFGPDTPTLNELKNKVEMLFLNINPIWEGNYPVPPAVVHMGGLHQKPPKELPKDLSQLLDNSKNGVIYFSFGTNVRPSLLDPAKIEIFHKVFAELPYNVIWKWDDESLQPRSDNVRIFKWLPQSDLLRHPNVKLFITQGGLQSTDEAITAGVPLVGVPMLGDQWYNVEKYVYHKIGVRLDFEDLTEEKLKQALLDVAENESYRNNIIRLRSLMQDQPQKPLERAIWWLEYVLRHGGAKHLRSPAANISWSEYLELELLSLVLISLVTSLVLITLVLRFTFQKLLQLYQIHYKEKML

SEQ ID NO: 7103 - protein, 524 aa, Stomoxys calcitrans
MKHLVYLCIIVHVIQLSPAIEAKEILGIFPHFGYSHFKVFYPLLRNLAEAGHNVTVITHIQSSNKLDNYEELLLKQMEVVNIVPLSEWRPRTWNGLLNEYVGLHEEGQESCERLYESGYVQEVLRRHQEIKPYDLVITEYFNSDCQLVVPYLMNTPIVALSSCLLMPWYYDRILLPDTPSFIQSEFIGFSTPLNWFERLTNFLQAKVLSLLYRYHTNQKDNDLIYRHLNVTVDVADIARQQTSIIFGNQHYSLTGTRPQPTSFIEIGGIHIQEKVIDEPMPRDIDDFLQTSGKEGVLFISWGSMIRASTISSDKLTAILKVLERSNLKIIWKWETEEVPVKNDKFLFVKWAPQLTLLCHPKVKLFWGHGGLLGTTEAVYCGKPMILTPIYGDQFVNAHAVENRQIGRILSYDNINDSSLEDALQTVRHSSYAKNAQDISNIFRDRPSKPLETATWWVEYLLRHKRAPEVLHSHAVNLNWFILYSLDSICIIVVTLLLIIFVLKYTLKLMMKICRNKNDEKLKKH

SEQ ID NO: 7104 - protein, 334 aa, Leptinotarsa decemlineata
MLNFQGDLSFIDKLKSFLFNIWYRAIYYWYALPMADRVARKYFGEDMPYLGDIERNISLLLLNVNPIMQTVRANVPNVIEVNQMHIREKKPLPKDLQEYLDSSSEGVVYFSLGSNVKSANLTSRMRDVIMGAFSEVPYNILWKFETDDLSGRPDNVLTRKWLPQQDVLGHPNIKAFITQGGAQSIEEAIYNEVPMIGIPFITDQPTNVRRVVDLGMGLGLDYRTMTKGQLKNAIQEVIENKKYKKRVQESKAILVDQPIKGVEKAVWWIEYVIRHKGARILRSPSADMPFAEYFMLDVIGFILLCICLSFYAVEKVFALLRYILYSRRTKLKEN

SEQ ID NO: 7105 - protein, 530 aa, Mesocricetus auratus
MAPAGSPASLPLCVCLLLASGFAQAGRLLVVPMDGSHWFTMQSVVEKLIHRGHEVVVVVPEVSWQLRKSLNFTVKTYSISHTIEDLNREFKFFMDAQWKPQHEGLVPILGSPAQRFFELLFSHCRDLFNDKKLVEYLKQSSFDAVFLDPFDVCGLTVAKYLSLPSVVFGRTMFCHYLEEGAQCPSPPSYVPRAHLKLIGTMTFTERVWNHLAYMMERAFCPTLFKVATEIASEVLQTPVTMDDLVSQVSMWLLRTDFMLEVPRPMMPNIVFVGGINCHQGKPISKEFEAYVNASGEHGIVIFSLGSMVSEIPEKKAMEIAEALGRIPQTVLWRYTGPKPSNLAKNTILVKWLPQNDLLGHPKTRAFITHSGSHGIYEGICNGVPMVMMPLFGDQMDNAKRMETRGAGVSLNVLEMTVDDLENALKKVINDKSYKENIMRLSRLHKDRPIEPLDLAVFWVEYVMRHKGAPHLRPAAHDLTWYQYHSLDVIGFLLAIVLTVVFIVFKCCAYGFRKCFGKKGRVKKSHKSKTH

SEQ ID NO: 7106 - protein, 516 aa, Papilio xuthus
MKLLVLILLFNFKFSNIYGARILAVFPIPSISHQIVFRPIIKELLKRGHELVVITPDPAFPKGKAPVNLTEVDVHDLSYSSWERFIQRSEDTGSIWADKVVFILSVIEQVFEEQMISEQVINLLKQNEKFDLILVEACVRMTLGLSHVFKAPMIQISSFGSPFKNSESIGTPFHPFLYPSVFRHRINDLNIWEKLTELYNEFVFHNRLKSNEIHENKIMKRLFGEDTPTLQELFKKVEMLLLNVHAIWENNRPVSPNVIYLGGLHQNDKKDLPKDLQKYLDSSVNGVIYVSFGTNVRPSLLPLEKIKILTEVFSELPYDVIFKWDKDELPGQTRNIRIFKWVPQADLLRHRNIKLFITQGGLQSTDEAITAGVPLLGIPIFADQWYNIEKYEKFKIGRGLNMDTLNKETLAAAITSLIEDESYRRNIERLRTIMNDQPMRPLDRAVWWIEHVLRFGGAAHLKSAGAHVTWSEYFELDILIILILLTFISLILSSLFCIAAWKFLSKYIWNVKLKTF

SEQ ID NO: 7107 - protein, 540 aa, Drosophila persimilis
MTTWWRISRSVLIALWLIVITGTPPPAFGGNVLAVYPHFGFSHFKVVMPILNELARRGHQLTVISYVNHPQAAEWPNYEQLLISQAGEDQSSTTINLVPLSEHTPTRSLLTLFWEYIALHSEGQESCERLYASGHVETVLKRHQTKPYDLLLTEYFNSDCQLALAKLMDLPIIGLSTCALMPYYYDRIDLPDTPSFIQSEFVGFAGVLSWDERLVNFIQAKMLKLLYKYHSIRADNALVRKHFGIDVDVDEVARTQTAFIFGNQHYSLMGSRPQSRQFIEVGGVHLTSQAEQELPPNIAQFLDQSEVPIIFISWGSMVRISSIDADKLAAIVEALERQPLRVIWKWEADEKPKMDSTKFLFVKWAPQLALLCHPKVELFWAHGGLLGTTESVHCGKPMLVTPIYGDQFLNAFSVQNRGMGLKLDYEEIRVTSVTQALNELNNTSYATRSLGISKIFNQRENSPLESAIWCVEHVIQHGLLAAEMLQSPGIELNWFVYHSLDSVCLIFVVLMVLAYSLCHFSGGSSSKSFNGNRRRKSKRS

SEQ ID NO: 7108 - protein, 423 aa, Papilio polytes
MKIVGAIVLFTLHFSNIYGARILAVFPVPSISHQIVFRPIIQELLKRGHELVVITPDPAYTENKTPVNLTEIDVHDLSYSTWERFIQRSEHPKSCWVDKVLFIISVVEQVFERQMNSQVVRENVLNGNEKFDLILVEASARMTLGLAHVFKAPVIQISSFGSVVKNYEALGTPFHPFLYPSVFRYRIYDLNIWEKFAELYKEIKFHYSLQNSEIRENEVMKQLFGADTPTLHELYPKVELLLLNVHAIWENNRPVPPNVIFLGGLHQNDKKELPKDLQTYLNSSVNGVIYVSFGTNVRPSLLPLNKMKILTEVFSELPYDIIFKWDKNELPGRSGNIKISKWLPQADLLRHPKIKLFITQGGLQSTDEAITAGVPLLGIPMLVDQWYNVEKYEKFKIGRGLDMDTLSKETLAATIKRLEHIVS

SEQ ID NO: 7109 - protein, 512 aa, Neodiprion lecontei
MNLIATCFVLGLAGGGEGARILGLFPIPGKSHLSVTSPLMHALAKKGHDVTVFVPFHTGFNASNYREITYDSIPLDKHGNIMDYLNMNIFLAHIFLYYMGTLTTEMALNTTGAQALIKSEEKFDIIVMEQFFNEAFLAYVHKFKCPFVLISAFGPTATINGIFGNSAPYSYVPSEFLPFGDRMTFFERLENTIANLYFDGSRKYYYMPQQQALANKYLSDTGKEVPSLEEIESQADLILLNSHHIFSTPRPYMENMKNVAGMHLKPSKPLPLDLQQYMNSSKNGVILFSLGSAMQSILMPDDKIKALKGAFERLPYDVLWKWENDTMENKPKNVRIGKWLPQSDILTHPNLKLFITHGGISSLMETVYHEVPIVGIPLFGDQRRNIKIAESKGYADYVDILTLTENQVYNAVMNVATNPKYRDNVKKVSAYWKGEMNHPLDVAVHWVEYVLKNGGAKLLKATVTEQNFIQYFLLDVGFAILLLLILTCILIRKTFRLLCRKSRPKMTSKKNN

SEQ ID NO: 7110 - protein, 521 aa, Copidosoma floridanum
MITRSLLTLLLYGLSLCTGARILAIFPFELKSHRGVLEPIIEELAVKGHHVDVISTFKLSKNLPNYTNILTLPTSKEPPKILYSDNYTPYDDYVWLVKVNNRVCNLLGHPVISELIKNPPKNPPYDLLIVHILSGYQCMSAIGVALDIPVVGVMTTLPYPQMEHYLHNPLHLAGMSRHCRSFEENFGFWGRLYNVVMTNYYITHHYKHADAQDHYIKKYLGPNMPSYREIEKSYSLIFSNSHYLYHGVKPKVPGLIEIGGINVMNDTSPMDPKLKKVLDESKDGFIYFSFGSVVVVESLPHEIVDKFYSTIRKVAPIRVILKSSNPETLPKNLPKNVFTFPWLPQQKVLQHPNIKAFVAHGGALGTLEAIYYRVPMICVPFFAEQYVNCDISKHRNISLKLDIKTAVQKDYDYVFSQILTNPFYKQSINKFSALYWDRPQSPREAVTYWVEFVLRHGKDVLRTQGLALNWWQLELLDVYVFLITCALTTVLIVCLIARKILRLFLQVRSMSSIVKSSKKLM

SEQ ID NO: 7111 - protein, 533 aa, Equus przewalskii
MAAGSQGPRLLVLGLLLCVLGPAVLQAGKVLLVPIDGSHWLSLVGVLQQLQQRGHDIVVLAPDASVYIKEGAFYTLKRYPVPFRREDFEATFISLGHSVFENDPFLRRVVKTYKKVKEDSALLLSSCSHLLHNNEVMTSLVESSFDLVLTDPFLPCGPIVAQYLAVPVVFFLNALPCSLDFQGTQCPNPPSYVPRSLSSNSDHMTFLQRVKNMLIALVESSLCSVVYSPYAPLASEILQKDVTVQDLMSSASVWLLRGDFVKDYPKPIMPNMVFIGGINCVSKKPLSKEFEAYVNASGEHGIVVFSLGSMVSEIPEKKAMEIADALGKIPQTVLWRYTGTPPPNLSKNTILVKWLPQNDLLGHPKTRAFITHSGSHGVYEGICNGVPMVMMPLFGDQMDNAKRMETRGAGVSLNVLEMTSDDLANALKTVINDKSYKENIMRLSSLHKDRPVEPLDLAVFWVEFVMRHKGAPHLRPAAHDLTWYQYHSLDVIGFLLAVVLGVAFIVYKSCAFGFRKFFGKKGRVKKSHKSKTQ

SEQ ID NO: 7112 - protein, 426 aa, Pieris rapae
MYRIILFSFFITAQNSNGARILGVFPAASISHQVVFRPLTQELARIGHEVTVITTDPAFNDDNRPANLTEIDVHDVSYNVWLQKMKEKPIKFGDKSDVFKLVEEMAVFFGIIIEEQLKTDGVQKLINNKSKKFDLIIIEASARPAIMFSHLYKAPVIVISSFGMAFGGEDLFGAPSHPILYPNMMHQRLYNLTFWEKFYEFYKHYWILHMWESTENKEFNLLKKYFGGDDVPSYKELYKNVDMMFLNIHPMWSHNQPLPPNVISIWGIHKNPQKSLPQDLKTYLDSSKNGVIYISFGSNARSSMLPPEKIKILINVFSKLPYNVLWKWETGVLPGKSENIKIAKWLPQSDLLRHPNIKLFITQGGLQSMDEAMNAGVPLIGIPMFGDQWYNVESFEYHKIGVQIELDTITEEQLTKAIETVINDKR

SEQ ID NO: 7113 - protein, 495 aa, Caenorhabditis nigoni
MADIIADHGHNVTLFQPFHNAMKNTEGLVKNKNIEIINYYPDHYEELEKLETETFPGFWDSHLMNNPILQAFMMPRSLVGEFRKTAVQLLKDQKMLDELKSKNFDVVISETFEITGFYIAHLFDLPCIPIMSSVRFPIFNELFGQPSSLGYLPAIGSNMAPEAGLFDRLNDIFRNFLFMNCMERMSDLQQTFIEEAIGRPVPHWRDLIKQSPIYMTNSNPYLDFAVPTTSTIVHVGGITMDLKQMKHVGKLPEEYVPILSERASTVLISFGSVIRSFQMPENFKAGLIKMFESLPDVTFIWKYEKDDVELQNKLPKNVHLKKWVPQPALLADKRVKVFVTHGGLGSTMEVAYSGKPALMIPIFGDQPWNALMLARHGGAIAYDKFDLQDGEKLTRTMKDMVENLKYQEKAQELLEILSNQPIDPKLNLMKHLEFAMQFPNLRSQVPAINQVGTIAHYYLDAIAFIAIFAILFVYVSYRIACKLPIRLVSKKVKSE

SEQ ID NO: 7114 - protein, 522 aa, Bicyclus anynana
MTIKVLSLLCYAIVLTSIESARILAVFPFPSISHQFVFRKLTLGLANRGHEITVMTPDPAFPQGNAPPNFKEIDVKEISYKIWQNLFQANYKVDRTFVSFREIRTSVRLTGAILKKQFETPEMQEIVTNTTRKFDLILVESMMHPAIVLSHILKAPLILVSSFGGIYNNHHIMGAPTHPLLYPSVFHRRLYKLSIWEKIKELYEHFFIDYALYLNEADETAFLRQLFGPDIPTMNELYNNVDMLFLNINPIWADNRPVPPNVVYMGGIHQSPEKELPNDLKTYLDSSKYGVIYLSFGTNVMSGMILNDKIQMIIKVFSNLPYNVLWKWDKDELPGKSNNIKISKWFPQSDLLKHPKVKLFITQAGLQSTDEAITSGVPLIAIPIYGDQWYNAEKYVKHGIGKQLDINKLTEELFKNAVETVITDESYRKNIVRLRQMMHDQPEKPLERAIWWAEYVIRHGGAKELRSPSANLSLVDYYEVKLILLVMSVVLIALITLILAVVFVTKYVKTKIRRTITEKKLN

SEQ ID NO: 7115 - protein, 536 aa, Ceratitis capitata
MKMKEETAILLLAFALFIATAQIATVNGSRILGIFPHFGYSHFKVYYPLLRALAERGHHVTVVTYIAALNETKPANYEELLLKGRETTNMITFADVLPHRTLYDILTEINFVHNEGQKACKRLYESVYVDKIFKRHERKPYDLVITEYFNTDCQLGIPYLLQLPVVGLSSCILMPFHYDRIALPDFPSYVQSEFVGFPEVLKWHERLLNFLQMKLLKHIYRYRTNYYDRRIINKYLNVDFDVDDFAKRSTGLIFVNQHYTLHGNKPLTPQLVEMGGIHIDETAVNATLPAKIEKFLKNAPLAGVLFFSWGSMVRSSSMPTEKVQTIVKVLEQQPFHVIWKWETDEVPTKSKKFLFVKWAPQLSLICHPKVKYFWGHGGLLGTTENIYCGKPLIVTPLYGDQSVNANAVQNRGVGTILLFDDINEKNLRATLMEIRRKSYADHAAALSHMFRHQDKKPLDRAVWWVEHLLQENGKTAHKLLQTKAVKLNWFVYYSLDSVAIILLGLAVILYIVRAFLRLLCGFFCKQGKQSGKVKTK

SEQ ID NO: 7116 - protein, 525 aa, Hemileuca sp.
MNSKTSYSTLFNRIFLFLSFTVVINHHVTDSAKILAIFPTPCYSHQSVFKVYIEALADRGHEVVVVKPTTKVRYNDDKNIVEIDASLSDNYFAKLVHDSMSFRKRGLVADSDTVTAYNYMGLVRMLRDQFDLPEVKKLIENRHLFRFDVLITEAFLDYTLIFSHLFGDIPVIQVSSGYGVPENFETMGAVSRHPVYYPNLWRDRFRDMNIWETIREIYMELRLQNEFSVLLAEQNNLLKMQFGANVPALEKLRDNVEMLFVNVHPFFDNNRPVPPNVQYLGGLHLHDKRVKPLSEHVQRFLDNSTNVVYVSFGSSIDTAQMDNEFLDMLLETFRSLPQCNFAWKFDSIIDSSRVVPDNVFIQSWFDQYSLLHHKNVKAFVTQGGVQSTDEAIAALVPMIGMPMMGDQSFNTNKYIDLGIGLVVDTSTVTSQQLIKAIQTITVIDYDKYKGNLMELRKLIRHQPVSALHKATWFTEHVITHKKKNYYKTKSSNATYDEYYMFYIIIPFASVFIMNHIHQLLRMSFS

SEQ ID NO: 7117 - protein, 531 aa, Caenorhabditis brenneri
MKVLTLLLLLIGAVSSYKYVVFVPNMANSQVQFCARVAEVLANGGHDVTMLFISHLPDYKTDVKIPKGVKTYNLDAFVEGLTKKSIEKEQSAMIFKDTGLKDMPAMMAMFSRFGKMFQDGCRMMVQNKEFMAWLENEKFDVAYAYIYSSCPIGLIHAAKIPSWVWLNSGPLMDFVAETVGVPIIPSYVPPVMMESHDEMGFFFRTKSFIGHVLMGLLHRRMTSNGETQIFREELNDPNFPHTMDLGAKCPLIIVNTNEIYDLPRPTLAKVVNIGGLGVGFDAAKPLTPEFKKIVDTGKGLIVFSFGSVAAAHEMPLAWKNSILEAFASFPDYQFVMRYVADDLNDRLPKNVHLFKWLPQKDLLLQNKTKAFITHGGYNSMQEAISAGVPLVTIALFGDQPKNAKVAKKHGFAVNVQKGTLSKETIVEALKEVIENDSYKQKVSRLSAMVRAQPMKPAERLLKWSEFLAEFKQLDNLEPAGQKLNFFQYHSLDVIGFLFVVILLVLYVIFRILKALVRCCCCRRRSDKKKTE

SEQ ID NO: 7118 - protein, 530 aa, Marmota marmota
MAPGLLPAALPLCVCLLLASSSAQAGKLLVVPMDGSHWFTMRSVVEKLVHRGNEVVAVMPEVSWQLGQSLNFTVKTYSTSYTLEDLDRGFNFFVDTQWKTPEQSMYSAAMGSSKAFFDITFSRCRSLFNDKKLVEYLKETSFDAVFLDPFDVCGLVVAKYFSLPSVVFARVVFCNFLEDGAQCPSPLSYVPRVFLMSSDALSFMERIRNHLNYLEEYLFCPYFFQTALEVASEILRTPVTIGDLFSQISIWLLRTDFVLEYPRPVMPNMIFVGGINCHQRKPLPKEFEAYVNASGEHGIVVFSLGSMVSEIPEKKAMEIADALGRIPQTVLWRYTGTPPSNLAKNTKLVKWLPQNDLLGHPKTRAFITHAGSHGVYEGICNGVPMVMMPLFGDQMDNAKRMETRGAGVTLNVLEMTSDDLANALKAVINDKSYKENIMRLSRLHKDRPIEPLDLAVFWVEFVMRHKGAPHLRPAAHDLTWYQYHSLDVIGFLLAIVLGVAFIAFKCCAYGCRKCFGKKGSVKKGHKSKAH

SEQ ID NO: 7119 - protein, 524 aa, Helicoverpa armigera
MTDFSYFIVVHTLVLLLSQGEAAKILVYINTPSISHQVVFRPLTQALAARGHEVTVVTTDPAFPKGGAPPNLTEIDVHDISYNIWRTEVMKASRGEEIDDILAPLRVMLYAVEKVLEAQLQHPEVQALIKGTKNKHFDLMIAEAAMPMLLAFAHIYKTPVIQASSLGAYFGNYETVGAPTHPFLYPHVMRRKLNNLSVWDKVTELYDQYRLEKLIADAQPFENALVEKYFGPGIPPVSELLKNVDMLFLNVNPIFGDVRPVPPAVVFMGGLHQNPEKDLPKDLKTFLDSSKHGVIYISYGTNVDPALLPLEKIQAMIGVLSQLPYDVLWKWSKDELPGRTPNIRISKWLPQSDLLKHPKVKLFITQGGLQSTDEAITAGVPLIGMPMIADQWYNVERYVAHKIGVRLDMETLTEENFKNAINKTIGDDSYRKNIVRLRNIIQDQPQKPLDRAVWWTEYVIRHGGAKHLLSPAAHITWTEFLELKLVFTLLAVFLTAVVAVLIALYLVFTFVRSFLKGSVKVKRS

SEQ ID NO: 7120 - protein, 517 aa, Trichoplusia ni
MHIYFHLLTFFTVLVNLNGAAKILGVFPTPSISHQVVFRPLMLELVKRGHDVTVITTDRAFPIGETPANYTEIDVHEESYRIWRDRIMKASSAKDGIQTLIQGLRIFPDVFDTQLSDENVQRLLRDNKHFDLLILEACFRPALIFSHIYKAPVILMSSFMAVLDNYETIGAPKHPFLYPEYLNQKLSNLTMWDKITELYTSYKMKFLYARNVDYENNIVRKYFGENTPSLAELGNNVDMMFLNVYPVFAGIQPVPPSVVFTGGLHQKPEKPLPQDLKTYLDSSKNGVIYISFGTNVDPTQLPPERIQVLVKAFSELPYDVLWKWNGDELPGRTENIKISKWLPQSDLLRHRKIKVFVTQGGLQSTDEAITAGVPLIGVPMMGDQWYIVERYKTHKIGVRLDLGDITVESFKTTLLKVIGDDSYRQNIVRLRSLMRDEVQTPLERAVWWTEYVLRHGGAKHLRSPAANISWAEYLELELVLTLLAGLTVTLALFVFFIYNFYKLLVKNNVTTIKSKSD

SEQ ID NO: 7121 - protein, 519 aa, Chaetura pelagica
LVLLLSMLHVAAGGKLLVVPADGSHWLSMTEVLDQLSLKGHEIVVLAPEHNLYIKPRKSFVMKSYPVSFTQEELEHTFWKTTQNAFFKGSLLERILKNYEGVKNTSVIFLDTCSSLLYDEELMKYLQDSKFDAVMVDPVLPCGPILAEHLSLPSVYFMRGLPCTLDYKATQCPSPYSYVPRSFTDNSDHMTFMERVKNLLIGFSEHLLCYVFYLNHENLASEFLHRDVAVLELFSKASIWLMRYDFVFEYPRPIMPNIVYIGGINCEQKQPLSKEFEAIVNASGEHGIVVFSLGSMVSDIPRERAKEIAKALGTVPQTVLWRYTGEVPPNLPKNVKLVKWLPQNDLLAHPKTRAFITHGGSHGVYEGICNAVPMVLMPLFGDQMDNAKRIESRGAGLTLNILEMTSEDISTALKAVINDKKYKDNIQRLSDLHLDRPIHPLDLAVHWVEFVMRHKGAPHLRPAAHDLNWIQYHSLDVMAFLLAVVLLSLFISLKCCLFCCRRCCCKKGRTKKATKAKSH

SEQ ID NO: 7122 - protein, 520 aa, Spodoptera litura
MKWSVLISLIYFLSDVEGLKVLICFPLPVKSLSILGQGAVRHLMEAGHDVTYITVYPLKIKAKNFRQIDISTNTALVASDESLTMEYILNHKLERNPPNQVQEFAVEALKMTLNHENVKKLLEDPNEHFDVIITDLIESEVYAGLAVLYNCPMVWLYSMGAHWQVLRLIDVASNPAYDPDYLSPNMPPLTFTQRAEELWSRIYWQYLKTFYTQPEERSIYEEVFGPLLAKRGRPLPDYEDVMYNASLIFANEHDATRNRASTPQNFKYIGGFHIEEPVKPLPKDLQDLIDNSKHGVIYFSMGSVLKSNSMPRKLVMDLLQMFGEFKQTVIWKFEDNSLQGVPKNVHIVNWAPQPSILAHPNVKMFISHGGQLSSLEAIHFGKPIIGIPVFFDQFTNIHKAAQNGYALRVPLSQNLPRDLKPAINTMLSDDRYAKQVKELSDLYHDRLTKPGPALVYWVEHVVRTRGALHLRSPALHVPLYQRLYLDLLAIILIITFSIIFLLIRLCNNKNGKRNDKKKSN

SEQ ID NO: 7123 - protein, 513 aa, Athalia rosae
MRLIATLVLLCLMGREGFGAKILGLLPFPGRSHLSVSSPVLHGLAKKGHDVTAYVPFSTGFNATNYREIVYEHTPITNSIDVLSVVNVNAIQKPFGFFFMGIFTTEMALNTTEVRDLIRSEEKYDLIVMEEFLNEAFFVFAHKFKCPVVLVSTFGSSAVVDQIFGNSAPLSYVPSLFLVADDRMTLIERFQNVLVTVYTNLLRDLFYMPRQQALAVKYLGDSGVEIPDLGEIERQADFILVNSHPAFSTPKPYMPNMKDVAGMHLKPVKPLPADLKEYLDSSKTGVVLFSLGSAMQSVKMPENVLRVLKKSFERLPFDVLWKWENDTMTDKPKNVRIGKWLPQNDLLAHPNLKLFITHGGISSLMETVYHGVPIVATPLFGDQMRNIMLAERRGYAIYLDFQTMTENQIYEAVMKVANDPKYKENVKKVSAYWRDDLNHPLDQAVHWVEYVLKHDGAKHLKATVTEQTFVQYLLLDVAFLILTILTLTFLAVRRMFRSICRRTGPKAISKKTN

SEQ ID NO: 7124 - protein, 1056 aa, Pieris rapae
MYRIILLTFLITAQKSNGARILGVFPAASISHQVVFRPLTQELARIGHEVTVITTDPAFNDHNRPENLTEIDVHDVSYNMWLQRIKDTRMEFGDKSGVFKVAEEMATFFGTIIEEQLKTDGVQKLINDKSKKYDLIIIEACARPAIMFSHLYKAPVIAISSFGMAFGGEDLVGAPSHPILYPNMMHQRLHNLTFWEKFNEFYKHYWILNMWESTENKEFDLLKKYFGGDDVPSYKELYKNVDMMFLNIHPMWSHNQPLPPNVISIWGIHKNPQKSLPQDLKAYLDSSKNGVIYISFGSNARSSMLPPEKIKILINVFSKLPYNVLWKWETDVLPGKSENIKIAKWLPQSDLLRHPNIKLFITQGGLQSMDEAMNAGVPLIGIPMLGDQWYNVESFEYHKIGVQIDFDTITEEQLTKAIGTVINDKSYKENIIRLNRLMNDQSQSALDRAVWWTEYVLRHGGAKHLRAAGANISSFEYYEIEFLLKLVSLVFSIAAIILYLMYRLFRIVVPSNLPSSKSKTSYVNIYMVALYTMIKSTVLLNIIFLLSQINAARILAIFPTPSISHQVVFRPLTQELARRGHEVTVITADPVFTKDNRPKNLTEIDVHDISYRAWRDGIDERDTGFGKRNGVFQIVKNIEEFLQEILELQVNTEEIHALLNDDSKFDLLIIEACVRPALMFSHKFKVPVIQISSFGFMLGNDEVIGALTHPILFPIIMRQRVFNLTFWEKLYELYLHYWITYHWHMSETREHEALSKYFGNNVPSYKELNNNIDMIFLNIHPIWTNNQPLPPNVISIWGIHKNQEKPLPQAIQEYMDSSKNGVIYFSLGSNAQSTMLHLDTINMLIDVFSKLPFNILWKWEKDELPGISKNIKISKWLPQTDLLRHPNLKLFITQGGLQSTDEAINSGVPLIGIPMLADQWYNVEFYEHLKIGVGLDIETITREKLLKAIETVISDKSYKENILKLRNILNDQPQSALDRAVWWTEYVLRYGGAKHLRAASANLSWFEFYEVEFILKLLMLICATLLVLIITSHLVYRRLRCFMYSHKVESIEKKQM

SEQ ID NO: 7125 - protein, 532 aa, Myotis brandtii
MACLPRAVRGISAGVFLLGLWGVTLSDKLLVVPQDGSHWLSMKGIIEVLSDRGHDIVVLVPEVNLLLKESKHYTRKIYAVPYDQEELQRRFRTFGNRHFAERSLLTAPLVEYRNNMVVVDLCFINCQSLLRDSATLSFLRESKFDALFTDPAMPCGVILAEILGLPSLYLFRGFPFALEHTFSRSPNPVSYIPRCYTQFSDRMTFSQRVANFLVNHLENLVFHFLFSKYEDLASDLLKRQVHLPTLYQKGSIWLLRYDFVFEYPRPVLPNMVFIGGTNCKKKGALSQEFEAYVNASGEHGIVVFSLGSMVSDIPEKKAMEIADALGKIPQTVLWRYTGTRPSNLAKNTILVNWLPQNDLLGHPKTRAFITHSGSHGIYEGICNGVPMVMMPLFGDQMDNAKRMETRGAGVSLNVLEMTSEDLENALKTVINDKSYKENIMRLSSLHKDRPIEPLDLAVFWVEFVMRHKGAPHLRPAAHLLTWYQYHSLDVIGFLLAIVLGVAFVVYKCCAFGYGKCFGKKRRVKKSNKSKAH

SEQ ID NO: 7126 - protein, 519 aa, Wasmannia auropunctata
MRVVTLVLLSISLFCTIQHGRGYNILGICPSASYSHQQSFQALMKALASRGHKVTVLSTVPLKNPPSNYENVDLSFSYISKDCTGLRHVGAYAILHQNLWGANLICRHQLFSPAIDKLIASNKTFDGIIIEQLWFQCYYALVKHYNFPVLIGFLSVGNLPYVMDSVGNPDDPNFNPDMAYPFTDKMTINERIMNILYTTYTRLYYRYWHLPRAQRMANERTPGTSVYDIDKNFSLVILGNNHVFGYPKPLLPHVIEVHSLHISENPGSLPKDIREFLDNAQDGAIYFSLGSNLQTDQLPAGPLTALCNALGSLKQRVLWKHDGNMAIHPTNIKFVKWVPQQAVLAHPKVIAYMMQGGLQSLQEAVHYAVPVVAIPFFGDQYFNARKILDAGIGLTLDIDTITENSIVQTLTEIVENKTYLNNIETMSAIVRDELVKPTNRAMWHVEHVLKFPNSRHLRYHGHDMSWTHYYATYLCLSIYFALLICINYILYNTIVSAFIKIKCISILKQWISNWKQKLD

SEQ ID NO: 7127 - protein, 520 aa, Trichoplusia ni
MGALLHLLACYILFVNVNDAARILAVFPTPSISHQVVFRPVTQELVRRGHHVTVITTDPAFPKGGAPANLTEIDVHDISYGIWKELFMTAPKGGKDDIVHHLKIFLNIFIEVFEAQTKTENVQRLIKNRDQKFDLIIVEACYRLGLGFRHIYEAPVVYMSSLGGVFGNFEVIGAPTHPTLYPTSVRQRLNNLTMWEKFTELYNHYTYIYMYYVQETAENNLLKKVFGPDAPTISELYNHVEMLFLNENPVFVGSRPVPPTVVYMGGLHQNPQKELPKDLKSYLDSSKNGVIYISFGTNVDPTLLPADRIQVLVKVFSQLPYDVLWKWNGDELPGRTANIRISKWLPQSDLLRHPKVKLFVTQGGLQSTDEAITAGVPLIGIPMLGDQWYNAEKYESHKIGVRLDLDAITEENFKEAINRVIGDDSYRKNIIKLRTLMRDQPMSPLDRTMWSLEHLLRHGGAKHLRSPAANISWAEYLELELVLTLLGGMFTVISLVVFGIYYLFKFFLRSKVADVKVKRS

SEQ ID NO: 7128 - protein, 526 aa, Cyprinus carpio
MRLIICVVYLAVFGPAQCGNILVWPTRGSHWINLKIILETVIDKGHNVTVLVPNPSPFMDTKESDRFSYQYFSVSMTTQDMQDFLNELVHFSVYETDQLNLLQIQIKFYELASKHQDMALSYCDGILQSPELMDKLRDGKYDVVLSDPHFPCSDIVAEELSVPLVYMFQFSIAHVLERMCGQIPSPPSFVPAGMIKLTDKMSFTERIINMLFYLSQDAFAILVWKRMDSYYTEYFGRPTSYCEMMGKADIWLIRNYWDFEFPRPFLSNFKYVGGLHCTPAKPLPKDMEEFVQSSGDDGIVVFTLGSMIDKMPKETSNMIASALAQIPQKVLWRYGGEKPDTLGENTKTYKWIPQNDLLGHPKTRAFVTHGGINGIHEAIYHGVPMVGIPLFGDQTDNLAHMKAKGAAVVMDNIKTTQPQDLVDGLNAVINNPSYKENAMRLSRIHHDRPVKPLDEAVFWIEFVMRNKGAKHLRVEAHNLTWYQYHCLDVFAFLITILTVVLYVFFKMCKFFIIRCCFRSKRKSKKE

SEQ ID NO: 7129 - protein, 512 aa, Helicoverpa armigera
MRSLAFFVLALTITDNDAATILAVFPVPSISHQIVFRPVIHELAKRGHEVTIITPDPAFPNGGGPATLKEIDVHFTYEEWKKFYEFTSVGDDDQVKQMEAVLKIIIHIFEVQMRVDEVQKVLKEKFDLVFIEALVRPALTLTHIFKVPIIQMSSFGPINFNTATFGSAWHPFLYPMNLSQKINNMTMWEKLQELWTFYQIEKVYENLEVDEHRMAQRLFGPDIPKLKELKDNVDMMFLNIHPLWDSNRPVPPSVIYMGGVHQKPQKELPEDLKTYLDSSKNGVIYISFGTNVQPSLLPPEKVQILVKVFSELPYDVLWKWDKDELPGRTSNIRIEKWLPQSDLLRHPKIKVYVMQGGLQSTDEAITAGVPLIGFPMLGDQWFNVEKYEQQKIGLRLDLDTLTEEKFKNALNKVIGDESYRQNIVKLGKILNDEPMTPLERAVWWTEHVLRHGGARHLRSPAANMSWTQYLELELVFIVLSVVLVFVLLILLLVYKLYKYISLYSIQRKLKDH

SEQ ID NO: 7130 - protein, 522 aa, Linepithema humile
MRILLLIFPWLLCSSICHGYRFLAIFPFNSHSHFMMFEQLVKGLIKKGHQIDVISNFPLKKPYPNYTDIVSFTPPVTLTNSLTYEFLTETLVGISPVFIVAGIAGNDLCKYLALPKIQELVRNPPKDPPYDAVLMEVFGAQCFAVIPHILNIPVIGVSSTVLYPWLYQIIAQPHNVAFVPNNCITGLTGSMNFLERLYNTVNMAYNNLLFNYLTSGQDEILKEHFGPNIPSVRELERKVALILVNSHIAVNIIQPTTPAVVDVGGLHVVDNDLTLPPALEKWMNESRDGFIYLTFGSMVMIETFPLKFLDILYSSLSKIAPVRVLMKVPRPDKLPPGLPKNIYTSPWMPQIKVLKHPNIKGFITHSGLMGMQEALVCGVPMIGIPLFGDQFINIDMFVGKNIAIKLDFHTMTEKDMDEALNAILWNPIYIETARNLSRKFLDRPMSAIDTANYWIKYIVKYGSDALRSPAMDLYWWQIYLLDIAVFFLLCAIIVIIVIRYFVRLLLQMINDNRNSSQTKKTN

SEQ ID NO: 7131 - protein, 434 aa, Spodoptera litura
MKGERGGARDLLAQVKEIMEALDKVLDRQLEDEKIQTLINDKSQKFDLLMLEGVLPPLLVLSHIYKAPVIQISTFGALQGTYDSVGAPTHPLLYPINTRHKLRDLTLWDKLTEALTYYAAENLWYNFYYDLNNNILKKHFGPKVPTVEELTNNIDMIFLNIHPMFEGIRPVPPNVIYLHGLHQKPAKDLPQDLKSYLDSSKHGVIYVSFGTNVDPALLPPEKIQILVRVFSQLPYDVLWKWSKDELPGRSPNIKIAKWFPQPDLLKHPNVKLFITQGGLQSTDEAITAGVPLIGMPMLGDQYFNVERYVYHGFGIRLDMEALTEEKLKHAINATVEDESYRRNMERFRTLINDSPQTPLERAVWWTEYLLRHGDAKHLRSPSANISWRQYLELDLVLVLLSVLFIAVAVTVILLRLVYRVLRFYIVGDVKIKRN

SEQ ID NO: 7132 - protein, 525 aa, Pseudomyrmex gracilis
MRISMFVWLLLYLSTCHGYRLLGVCPFHAKSHFIMFEQLMKGLARKGHQVDVISAFPLKKPYPNYTDIVKLKPPVVLVNNITYDFMRQTLNANPTFAIATIGGNDMCKNLGHPEIQKLVRNPPKDPPYDAIILEAFGFHCFAIIAHLWNVPLIGISTTSLYPWLHRLIGQPENLAFVPNNYVTYVDDLNFWQRLYNSGNALFNKLYFNYLTTKTQNNILREHFGPDAPTVQELEKKFAIILINSHIVLNKLQPLVPAAIEVGGLHVQDENLKLQPELEKWMNDSKDGIVYFTFGSMVMIETFPREFLNILYSSLRKIAPVRVLMKIPNPDKLPSGLPENVYTSPWMPQIKVLKHPNVKAFITHGGLMGTQEAITYGVPMIGIPLFADQFKNIDSYVVKNAALKLDINTLTEKDMDEALHEILRNPIYKESAQNISRRLTDQPLSSLDKAIYWTEYVIRYGNDALRSPAVDLPWYKLHLIDVIAFLLLCALGLIAVVAFVVRAILEVTTNHGKTIEINNLESKKVK

SEQ ID NO: 7133 - protein, 533 aa, Camponotus floridanus
MLKKFIFYCTLMGLATISSSLSILLVQPIPSTSHHVWTMNLLKGLLSKGHHVHIVDIHEPNIKSKLAENMTYGIFDIMQQLHEAKDFNPSDWQKLNIFQMMYTVYDTGLLTCEKIVESREAKELLEMIKNVEFDVIVHDITLLQCLYGLWEVAKGEPPVVGYIPFGLAPWLKDYIGGTYYPTVRPYSCVDFAKPEGLWQKTWNTIYYIVDDFLRSYYYMPLSQRIAERYIGQKIRPLHELEKSITILLINTHSAFEPAIPLPPNAIEIGGLHVEPLQTTDEKTVIYSDNIREFLDGAENGAIIISLGTNVNWKSVGLDKLKAVTQALSKLKERVIWKLEIELSFHVSNNVMIVKWLQQNEILSHKNIKAIWTHGGLLSTQEAIWKGVPVIGMPFYLDQIPNVELLVLKGAGVRLDFATLSTESILDAFEKVLYNRNYTKNMKRLSNEFRDRPVPPLDLAVWWIEYAARNPHGSLESSLRSQSWVEQNLIDIYAFLFLILIVILSAILFILKKLFKFYCNRVYSVSKLQKRKQM

SEQ ID NO: 7134 - protein, 534 aa, Ornithorhynchus anatinus
MALGYQAVFLATVGVLFFITSSPPFAEAGKLLVIPMEGSHWLSMHPVLQELRHRGHVVFVLAPEVSELIKDDEFFTLQTYPVPYRKEELKAQVQSFALGNFKGGSWIERFFRTYEKMKTSAAIFLSACTHLMNNRELLKNLNVRKFDAVLTDPMDPCGSIVAEYLSIPAVYFLRGIPCGLDFDGTQCPNPFSYIPRMFSRNSDRMSFLQRVKNMVFAVSFSFLCDFIYSPYAHLASEVLQRDMTVVDVLSYGSIWLMRGDFVLDYPRPIMPNMVFIGGINCAHRKSLSQEFQDYVNDSGEHGIVVFSLGSMVSEIPVKKAMEIAEALGRIPQTVLWRYTGKPPANLAKNTKLVKWLPQNDLLAHPKTRAFITHAGSHGIYEGICNGVPMVLLPLFGDQMDNAKRVESRGAGVILNVLEMTSEDLSNALKTVITDKSYKENIMRLSALHKDRPVEPLDLAVHWVEFVMKHKGAPHLRPAAHDLNWFQYHCLDVIGFFLVITLSVFFIFFKSCMFCFRKCFPKKEKAKKSQKNKSH

SEQ ID NO: 7135 - protein, 1063 aa, Copidosoma floridanum
MKITILLIVLFTLSLASESRAYRILAVFPYNGKSHNIFFEALMKGLAKRGHQVDVVTHFPLKKPVKNYNDIISLDGTLESVMNNFTMEFISFMNDDSTNVISNLYGNRLCSFLGLDSMQKLMNNPPRDPPYDIVIVEAFTANCYFGLGYIFKVPVLAVSTAAEFPWISDFIGNDDNLAYVPNTFYHSIGELNYWGRVENFVTYFMELRKYHSATAKIQTEAMRKYLSSDIPDIREVEKNVALTLVNSNPIISGIKPITPSLVQVAGLHIEENDETLSPELKEWMDEGKYGVVYFTLGSMVLMETMPVEQLKGIFSALKKIAPIRVLVKIVDKSKLPSGLPKNVKTLPWTPQIPLLAHPNLKLFITHGGLGGLIEALHFGVPMIGIPLFSDQFRNCKLFVAKQMMVTISLEKLSEQTLDSALQTVLYDPIYKEKSVYYSKLFRDRPMSPMDTANFWIEHVIRNGPVLRSPALKYTWWQLALLDVYALFLFSFILALLLATFIIRMILKTILKMVSRNYHIETNKKKIKSDCVFKREKAFKMLQKTLFFLLFIITSLHQFSAYRILGIFPLNGRSHEMMFESLMKGLARRGHQVDVVTHFPPKNPPKNYKNIINLSGTMESLVNNFTIDFVLGMADDVGTHVATVYGNRLCHLMGLEEMQNLLKNPPSNPPYDVLITEAFGANCFMGIGRHLNIPVIAASSAIEYPWVSEFTGNNDNLAVVPNALYMAFGQMSFWQRLKNTLVYHNEIRKFQKLTEHPQTELMKKYINSSTPNIREIERSVALTLVNSHPIIYGVRPVLPTVVEIGGLHVEESESTLPQDLKKWMDESNSGVIYFTFGSMVLVETLPEATLKTLYRSFAKIAPVRILTKVADESKLPPGLPENVKTLPWIPQQAVLAHNNTKVFMTHGGLMGSQEALYYGVPMIGVPLFADQPRNVEAFVAKNMSIKLPLADFSEEKLDAVFKAILYDPKYTKYAKYYSNLFRDRPISAMDSAVFWVEYVARNGPNVLRPPSLTLTWWQLALIDVYGFIFLVFIVVKFMLFCAIKLVIQKLLSYFETKESTKKKL

SEQ ID NO: 7136 - protein, 529 aa, Drosophila willistoni
MLLWRLIAISMLLAAWGPVKSESAQILGLFQHPGKSHFAFFRPIFEELAKRGHNVSMYSYFPLKKPLANYTDFVFEGMGLLTDVIDLKGFDSEWKPLGLPFKIPTYFRLHDWGINACRVAMNSPLIDQLLKSPQRYDLIILENFANDCMYAVAHLLGAPVIALSSCAIMPWHYRRMGTPFINSVMPMNFLPHTDEMTFIDRLNNFIHFHTVNFLYNFVTQPATDKLIRERFGVGLPPIDDIVKNTSLMLINQHHTLTGSYPYAPSVVEVGGLQIAQAEELPAHFKSLFKRSHTGIVVISWGSMINPTTLPAAKRRALFDSISSLDEYSFVMRWANGAPPEDKPQNLHTFDWLPQRDLLCHPQVKAFISHGGLMGTTEAVHCGVPILATPFYGDQFLNAATIAKRGFGVIVDYREFDTDHITKALHVILDKNFADNVKRLSQSFRQRPQAPMDLAIWWIEEVIASKGSPQLLSQARYNNWFVQNSIDVYLCLLGIVWLLGRCIRLVSRLIRRVLALGRRKPDVENKMKQH

SEQ ID NO: 7137 - protein, 518 aa, Spodoptera exigua
MTSTIKLFLLTLTLSLTYNDAAKILGFFPLPSISHQVIFRHLTEELARRGHEVTVIATDPAYPNGDGPANLTEIDVHDFSYEQWRILYKLTSTGERDLIGQIRGAYHTLVNIVEMQLKVEPVQKILKEEKFDLLLIEACVRPALLLSHVVKAPVIQVSSLGTVDFNVGTIGSAWHPFLYPDTLSQRSYNLTKWEKIREFYTYYKLNRVMKVVEDAENLMAKRMFGPNVPSIDELKNNVDLMLLNTYPLWDNNRPVPPSVVYMGGLHKNPQKELPKDLKEYLDSSKNGVVYISFGTNVQPSLLPLDRVQLMAKVFSQLPYDVLWKWDKDELPGRSKNIRISKWLPQSDLLRHPKIKVFITQGGLQSADEAITAGVPLIGVPMLGDQWYNVEKYVHHGIGLQLDLLTMTEDGFKNAILTILNNDSFRRNMEKLRSVIYDQPQPPLERAIWWTEHVLRHGGARHLRGPAANMSWTEYLELELVFTVLAVVLAITLVLFYLMYSIWKYLTNIINPSKKLKKN

SEQ ID NO: 7138 - protein, 551 aa, Necator americanus
MITLLTLLFTVYSTFGYKMAIFVLDLSNSQLLFNERVAETLAEAGHDVTLVMIISQSDRDNSDIKIKSNVKLHVVNAPINFTRKEMEKRQEELTFKPSTYNMVSRLSAQTSMIVDTCRATLENKQLLQWLKEQHFDLAFAHMFDVCAVGLVHAAEIPSWIWLNSGPVIDYVAYLIGLPIIPSYTPPIMMAAVGEMNFLQRVKSLIGHGMMKLFWRRLIADPETQLFRTHISPEFPDLMDLAAKCPLVMANTNELYDMPRPTLAKVVNIGGVGVEIKDQKPLPNVALSYFFPKNQYFNVSTFQHIAEIVDSGDGTIFFSFGSVVASYKMPLEWKKIFLDTFRRFPKYQFLWRYEEDDIKDMLPSNVHLFKWLPQVDLLRHPRTKAFITHAGYNSFQEAILTGVPLIAIPLVGDQPKNAASAEHLGIGVVLNKGELSVSVVSRAIEEVITNTRYKKEARRLSRMVGNKPVTPTQLLVKWSEFVAEFQTLDNLVPAGTKLNFIQYHSLDVIFCLFLLVILILALIRFLFKLAIRGTFALVMLWPSFRSEKQKTM

SEQ ID NO: 7139 - protein, 518 aa, Habropoda laboriosa
MLVSPLVLVLLLFRQFSPAIGFNILGICPSASYSHQQPFQALMKALAARGHNVTVISTIPSKKPTKNYEDVDLSFTYERRDCTGLRHVGAFTLLQKNMREANELCEKQLFSPAITHLISRNKSFDAVIIEQLWYQCYYALVKHYNSPVLIGFLSVGNLPYVMDSVGNPDDPLFNPDMAYPFTNRMSMNERIWNIVYTAWTRIYYRYWHLPRAQMIVNKWTADVSVDEIDRNFSLVILGNNHVFGYPKPLLPNVIEVHSLQITERKEVLPKDIEEFLDKAEHGAIYFSLGSNLQTHQLPVGPLTALCNALSSVKQRVLWKHTGDMAIHPGNIKFVKWAPQQAVLAHPKVMAYVMQGGLQSLQEAVHYSVPVVAIPFFGDQLFNARKILDAGIGLTLNIDTITEESIVQTLTDVIENKTYYNNIKIMSEIVKDELVKPMDRAIWNVEHVIKFPNSKHMRYHGRDISFVDYYGTMVILVLPLFFTLLCGYLIFIRFVNIKEYVSMIKLQVRLRYFTKSKAE

SEQ ID NO: 7140 - protein, 524 aa, Musca domestica
MLATALIWIAALLAVIGPLPLTVDGRRHNLKILGLFPHPGISHFHFFHPILRGLAERGHDVTVVSHFPDKSPPVGYTDIPLTGKETLANSVDLKVFENRRFYNHFLEFFLLYEWGKEACNHTLRSEALYKVMRQKVRYDVILLEQFNSDCMMGVAHMLQAPVIGLSSCAMMPWHYERMGMPIIPSYIPALFLGQSEDMSLGGRIANWISFHALNLMYKVFSIPAADALVQYKFGHDVPSVGELVKETTLMFVNQHFSLSGAKPLPPSVIELGGVHIQKAKPLDVDLQKFLDNADNGVVFISWGSMIKAETLPVAKRDAIVRAVKRLKQRVIWKWENETLANKPDNMYISKWLPQRDILCHPNVKVFMTHAGLMGSSEAAYCGVPVVATPMYGDQFLNAAAMKQRGMGVVLNYEDIDENTVLKAIKKVLEKQYYDNAKMISYAYKHRPNTALDTAIWWVEYVANTEGAPLLKSSSTYMSRFVYYSLDVYTVLGLVVLTSVVTWGLLMRKLKTATRNRGTTKVKSN

SEQ ID NO: 7141 - protein, 519 aa, Ooceraea biroi
MRVLPIILVSLSWLMCSAYRFLGVFPQTTRSRFVILETVMKGLADKGHQVDIISSNPQKKPYPNYTDIAKLPLPQFFLNNMTYEFLRQAAGPNPTNIIATKFGNYVCEAWLGNSVIQKLVRYPPQDPPYDAMIMEVFSAHCFAAIAELLNIPLIGVSSTSMYPWLNDLIAQPENLAFVPNSYVNLRVPMNFWQRTYNVLNTLYSKLYFNYLTRSQDDIVRKYLGPKLPSVHKMNLSLILVNSHIILNGIQSMTPAVVQVGGIHIREDDSPVPHDLRKWMDDSKEGFVFFSFGSMVLIETFPRKILDVFYTSLGKIAPIRVLIKVWNPKKLPPDLPKNIHTSAWMPQLKVLKHPNIRAFITHGGILGTLEAIFYGVPMIGIPLFIDQFKNMEACVTRNVAVKLDVHNITEQNMDAALNAILHDPRYKENIRHLSQRFHDQPLSPVDTATYWIEYVIKYGDDVLRSPAMDLAWWQLSLVDVAVCFLLCAAAIITLAVFIVRFVMKMINRNQHRLLHSKKTN

SEQ ID NO: 7142 - protein, 529 aa, Anopheles gambiae
MISSKNNVAAVAFLCLVFVIGNNRVMVESAKILGIFPTASKSHWILGSSLLKELAQDGHEVTMISPFPLKNAPKTYRDVNIAYNTNLFDDIMDEVFEKIDDSIVEKMMELGTFVNEITNTTLSSPEVQALIHSDETFDLLILEIFLDDALLGFADRFNCPVVGMSTFGASSWVNSLTGSPQPLSYVPHPMSSFTDKMNFWQRLGNVLFSAFDETLLTAMCNPIQQRHYNHYFPNATRSLDEMRHHGVSLVLINSHFSLSFPRPYLPNLIEVGGFHVNRKVNPLPEDIKSFIEQSEHGVIYFSMGSNLKPSKMDKQKRNDVIKVLSNLKQNIIWKWDDDTLVVDKKKFLIGKWFPQDDILAHPNVKLFITHGGLLSCTESIYHGVPIVGIPIFGDQLLNMARAEQSGWGIGVTYTELNEQTFSKAITTVLGDPSYTANVKTISRRMRDQPLAPMDTAKFWVEYVLRHDGAKHLISSAQDLNFVQYNNLDVYLFIVAVFLTIVFVVRLSFRKLYRALFKRNRNTPTGKKTN

SEQ ID NO: 7143 - protein, 428 aa, Drosophila busckii
MELKLISCCLLSCLAAAYAGNILAVFPHDGYSHFKVVTPVLEELARRGHQLTVISFVNNTAANYEQLLLATEAEQATTINREYLNGMQTGRSLKNMFVEYFDLFKGAQTNCERLFASGYVQQVLQRHQRQPYELLLTEYFSSDCQLALGKLLGLPIIGLSTCALMPYHYDRIDLPDTPSHIQSQYVGYAQRLSWFERLENFIQAKSLKLLYAHHTNRADNALIKRYLHLDMDVAAVAREQTAFIWVNQHYSHLGSRPRTPQLLEIGGVHITEQAKQQLPTHIAKFLQQSPQGVIFISWGSQVLASSIDQHKLQSMLQVLSAQPLNVIWKWEADKLPLMNNEKFLFVKWAPQLALLAQAEVKIFWTHAGLLGMTEALHCGKPMLMTPIYGDQFLNAHAAQTRGVGLILSYEDIKAAQLKTKLAALSKPE

SEQ ID NO: 7144 - protein, 437 aa, Myzus persicae
MIVLKSNKMYLHFFSILIYSFAGSWIPAPVEGARILAVEPVGGKSHWNFMSGILRALVDKGHNVTVFTPFPEGNRENYTEVSTSTKAMTVLLDAGIEDLMGKFGDPIKIISLMSEMSISMCDVIYENSKMKEVLANKGSDFDIVIIEPAFSECVSYLAAKLNLPLIYTIPIPTLGVMERIFTGHVSNPAVVSFNLASFGVPKTFVQRTVNIALWTYAITVRQINELILKYKEPREYDLYAPIPPSLVFVNRHFVMEPASPIPSNVVEIGGIHLKAAKKLPKDILEFIEQSPHGVVYFTFGSTVKMTSLPENTKKAFMDALAQIPQRVLWKYEDEIENLPKNVMIKKWLPQREILLHPNVKLFISHGGISGLYETIDGGVPILGFPLFGDQPKNVDSLVNAGMAISMDILSVTKDEFLKNVLELLNNKKYMKNAKTAQ

SEQ ID NO: 7145 - protein, 521 aa, Microtus ochrogaster
MAEQRSWLPVSLFFTKVLFLEAAKILTIGAMGVSHYRLMNRVSLLLQDHGHNVTCLLYEKMSTPDLKKENMSYEIITWSLPEDQEKEFDNRFSLLVEELFIDRFNHHTLIKIYKYFADVCSLILSREDIIYYLKNKNFDLVFLDATESCFFLIAEKLEKPFVAFLPVQFSFLDFGLPSPLSYVPVYGSRLTDQMDFWGRVKNFLMFFDFSLKQRQIFSQYDATIQEHFAEGSRPVLSDLLLKAELWFVNSDFAFEFARPLLPNTVYVGGLMDKPARPIPQYLEDFITTFGDSGFVLVSLGSVASLYQTKELIKEMNSAFARLPQGVLWTCKDDQWPEDVRMASNVKIMDWLPQVDLLAHPNIRLFVTHGGMNSIMEAIQHGVPMVGIPFFADQPENMVLIEAKKIGVSVHVDTLKAETFAFTLKEVIEDKRYKSAAMTAKAIRRSHPLTPSQRLVGWIDHILQTGGGAHLKPHGFQQPWHVQHLLDVLLFLLGLTLATLWLLKKVLGLLLRPLCVAKEKKA

SEQ ID NO: 7146 - protein, 412 aa, Papilio machaon
MADKGFVSQHFNIDPSILLSLYSLRSVGTYESARILAMFPTPSISHQVVFRPLTQELAKRGHEVIVITPDPAYPKGQAPKNLTEIDVHDISYSKFKILMERIKDVARDVIKQVEVIIDSNNAVFEEQMKTESVQEILKYKDDYFDLILVEACMRPAIGLSYVFKAPIIQDLKSYLDSSKNGVIYFSLGTNVKPSNLPSDKLQVIINVFSRLPYDVLWKWDDEELPGRTKNIKISKWLPQSDLLRHPSIKLFVTQGGLQSTDEAITAGVPVIGIPMLGDQWFNAEKYVHFNIGHKLDIDTLTEEQFDNAIKSILNNNSYRENIVRLRSIMQDQPQSPLDRAVWWTEHVLRHGGARHLRGPAANISWAQYLELELVLTLAAILISSLIILFIVAKLIWNVLKVQLSAVIKVKKS

SEQ ID NO: 7147 - protein, 238 aa, Homo sapiens
MENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLTCVATAIFLFTKCFLFSCQKFNKTRKIEKRE

SEQ ID NO: 7148 - protein, 533 aa, Ceratotherium simum
MAVGLQVPLLALAGLLLFLSVGPQAEGGKVLVVPMEGSHWLSMRKAVRELHARGHQAVVVSPEVNLHIKEEDFFTMKTYDIPYTQDEFNHILLGQSHMIFEKAHFLKTFWRSMTILKNVSLLFQKSCEVLMYDKDLIRHLNASSFDVVLTDPVYPCGAVLAEYLKIPAVFFLRALPCDLDSESTQCPNPSSYVPRLLTTNSDHMTFLQRVKNMLYPLALKYICHVSLSPYASLASKLLQRDVSLVDILGSASVWLFRDDFVLDYPRPIMPNMVFIGGINCANRKPLSQEFEAYINASGEHGIVVFSLGSMVSEIPEKKAMEIADALGRIPQTVLWRYTGTPPPNLSKNTILVKWLPQNDLLGHPKTRAFITHSGSHGIYEGICNGVPMVMMPLFGDQMDNAKRMETRGAGVSLNVLEMTSDDLANALKAVINDKRYKENIMRLSSIHKDRPVEPLDLAVFWVEFVMRHKGAPHLRPAAHDLTWYQYHSLDVIGFLLAVVLGVAFITYKSCVFGYQKCFGKKGQAKKSQKSKTH

SEQ ID NO: 7149 - protein, 448 aa, Toxocara canis
MFSEMLEPGIELSDDIENAQAIIPLEVGQYTLEQLGFLVWHLDFIPDGIEGGFLQGDLFFQHSTNSATFKRVSNTSWDLVIADEMFPNSAATISLNLKQNFNTRIALFSTTDFFNTHSTLKALARNPVISPNYYLRHDRISYDVRSFACRLVAFRDALIEQISIGLLGDRIIRRGARRIGLNNGFVELFSTASITFNDYFDKYRWPTTISNTLVFTTTPCDVPQHLPASIEEFISDPRSHGTIYIAFGSIVDWTVAPSNVIESFTEALNSLHDYRIIWSIGAKVTQGLKTHIKTVAWAPQSAILQDNRTKLFFTHGGLKSIKEAICAGVPMLTIPFIADQMKNSLLAYQAGIAEIIHKRRITSAILLKAMHKILQDNNYRQKIVSMRSIYNDRIMVPIQLETFWVERILRSKRSEIAFRIRATQMSWISYSGLDIVLIPICVVLLSTQ

SEQ ID NO: 7150 - protein, 394 aa, Trichoplusia ni
MIRAKVLIYICLYTAVTYVDSARILGVFSMPSISHQVVFRALTFELAKRGHELVVFTPNPVSPAEGIPNNITEIDTGAVYLEWRLIKSTLETDEKQNEFLKTRFGPNAPTVRELRNNVQMLFLNAHPIMGNNRPVPPSVVYLGGLHLKPPKPLPQDLQTYLDASIRGVIYVSFGTNVRPSNMDQDFLDAFLQAFESLPYDVLWKFDGDNLERIPKNLKIQKWFPQRDLLLHHNVKAFVTQGGLQSSDEAIDAGVPLIGIPMLADQWYNVNKYVELGIGVQINALTMTADDLTQAVEKIVSDTSYRQNIRRVRAIINDQPESPLERALWWTEHVLKHGGNHLRAPSANTTWSEHLMLDVVLLVLSIILVTGFLLIYASFKIWNLLKYKLEKVKLH

SEQ ID NO: 7151 - protein, 528 aa, Ceratosolen solmsi
MTPSLVTAASCAFLALCLCLDASYALRILGLFPLHGKSHFLMCEGLMRNLAKRGHQVDVYSHFPLREPVANYTDYDLGGRIGILSNNVSYGSFDSRTNFAFMPLLMRLYGMPICELMDLPVFQKLMRDPPNDPAYDIVVIELFVAHCYLAWGHRLQVPVVTIITSTMYDWMNYPIGNPSNAAIEPSAFSSFNSPMTFPERLQNVLIKMYIVWTFDNYMSKQDKKVKELFGPDYPDIRDMQQDISLVLLNYHHSITGVRTFATSVQPVAGLHIEDTKDKLPKEVQKFLDQSSHGFIYFSFGSMMRIETFPKHVLEMFYTTFEKIAPVRVLIKVAKPEELPPGLPSNVLTQPWLSQIKVLQHKNIKAFITHGGLLGTQESIYYGVPMIGIPLFADQYFNIQSYAIKNIAVKIDIESITEECLTKAVMEVLHNPIYKQTVDKIGRIFKDDLVKPVDKASFLIEYVVRHGKDTLKSPILALSWWQRILLDVYGFIALIILITLYVIWLGLKMLSKAVWKIITAHSFSKLKEN

SEQ ID NO: 7152 - protein, 527 aa, Oryzias latipes
MGVRGWFPTAGLLAWLCCLSLGPVQGGKVLVMPVDGSHWLSMKILVKELSRRGHEVTVLVPESSLLIKGSKDYKTEVHKVPFTQEELNGKFDKLRESVFVKTPEFTDMFVNVQRLVEFTTLQVKGCESLLDSEDLMERLRGEGFDAMLTDPFLPCGSILAKMFSIPAVYFLRGLPCELDYKANQCPSPPSFVPVFYSGSTDKMNFLQRVKNFFMYNVQSYVCTVLYQHFDDLVSRRIESGMSYKDLLSHGAIWLFRYDFTFEWPRPLMPNMVLIGGINCAKKAPLPTDLQEFVDGSGDDGFIVFTLGSMVSTMPAEKAKQFFDAFRQIPQRVLWRYTGELPEDMPKNVKVMSWLPQNDLLAHPKIKVFITHGGTHGIYEGICNGVPMLMFPLFGDQGDNVHRLVARGVAEKLSMLDVTTETLLAALKKLIYDKSYKERMATLSSIHLDRPIEPLELATFWTEFVMRHKGATHLRVAAHDLNWFQYHSLDVIGVLAIVVITVLWVTLKCCSFGVRKCCGRRSSKKKSE

SEQ ID NO: 7153 - protein, 729 aa, Operophtera brumata
RSSHLETTMLLLLTISPSRKCPICSKYLSNGAHCDIDMEENLKSVPASPFVNFYRAYDMAKAFKIMGNDNCNRIMTNDEIRKIITSGDKYDLVIVEQFVTDCGLAVAYKVNAPTVGMTAHVLMPWTYSRLGAPNKPAFVPNHLFATGTKPHLWTKVQSAIINLAMNAYFTYAIQRSDQAIVNKIYPEVPDLESLGHNISLVMLNQYFPLTGSRLYGANVIKVGGMHVTQDNEIIDKELKSFLDMAKNSVVYISIGTVASNFPSDTLEEIMAFVQNSKMNFVWKVDDIKDNVAKNLLSRQWLPQTAILCHPNVVVAFISRSGMLSTTAAMHCGVPIVGVPLFGDQFSNADSAAANGLGVVLDIYTLNRKELASRNHDVTVINYFPFKNMTNIRQISIQDESGAYCDINIEENLKSIPAANHFVNFHRAYNMATRLKSMGNDNCQRIMTKKETREMITAGDKYDLVIVEQFVTDCGLAIAYKLNAPTVGITAHILMPWTYPRLGAPNNRSFVLSHDLATGTKSSLWRKIENAIINLAMNAYFTYAIQRSDQAIVNKIYPEVPDLESLGHNISLVMLNQYFPLTGSRLYGANVIEVGGHPNVVAFISHSGMLSTTEAMHCGIPIVGVPLFGDQFSNADSAAANGLGVVLDIYTLNRKVLEEALQTVLQDSFQQRAKELSVLWRDRPVSAMDTAVFWIEYVARHQGRINLKPATGYLDMTEHLMWDDTVPLEC

SEQ ID NO: 7154 - protein, 450 aa, Trichinella spiralis
MQIHITLYVFICLTYGFISELFAKDFRGNVLHFACGISKSHVLFNERLANVLSENGYKVHIVFAPVTPGVDLPDFRNNKNVEVIKINFTITENVFTLGKQWQNDRLLIDSCKILSENSALKQHIETVQYDVLLNYCLDICPLAFGWKGKIPKTICISPSTVIFESVASIVGTPIRPSFIPNGGSAYSDKMTFFDRLKNSLLSSLMLLYPQLPVSAHKTEESIFRTIYGNDFKSITELNSNIVGMLINGEASLEFPRPLLPTVLYLGDLLPPKSSRLSTKELLDAFSRFPNYTVVCKLSVDESQKHYLPPNVKLFDWIPQRELLDHPKLKLFITHAGYNSLLETAKVGVPMITIPLFGDQLSNALRAERQKLSLVLSKLEITSENLENKMKIILENETYFNRAKQFAGFIHDKPLSNADMLIRYMDITIRRQQLVRSAVLNLNNIQLIVAE

SEQ ID NO: 7155 - protein, 516 aa, Acyrthosiphon pisum
MSCPIIITILVLCGCSTIIFPADSARILAVELTGGRSHWNFMRSVLQSLIEKGHNLTIFSPFSDIEGCGVNCSLIDTSKDYPTTGSINIATVLKTLSSTVSLISQSVNITRNRCNAMYNNTDINKILMVRNNSDYEVLLIEPMATECASHLAGILQIPVVYLIPSPMLTFVEPILFGHTPNPAVVSHILSQHAVLRKFVQRCINSVLLAYSLISREYYEWIIKKNHPQSYDSIESVKPSLVFVNSHYITEPSRPVPPNLIPIGGIHLSQPKTIPKDILEFIENSPHGVIYFTFGSVVSMSTLPDHIQNAFKEAFAQVPLRVLWKYEGEMKDKPINVMTSKWFPQRDILMHPNVKLFISHGGISGVYEAVDAGVPVLGFPLFYDQPRNIDNLVEAGMGISMDLLTLQKDELLTNILELINNEKYMKNAKIVSDRFKDRPMSPAESVVYWTEYVIRHKGAPHLKSHAFNLTWYQYFLLDVIFVIFIFISFVIFIIYKLFKTIYYYFLKYSQTIKPKLQ

SEQ ID NO: 7156 - protein, 522 aa, Caenorhabditis brenneri
MRKLLLFSILPVFANCLNVLFYVSVIAQSHIPFHNTAIKVLLDRGHNVVRSCDSPLNEMVKIHFPAGIRQNYTFGYDDPHFWSKHALHLFNIFEKKQVPYAEFLAFDELTFQLCEKVVHDVDLLEYIKRGKYDIGLSSDYDPCANIIMHAGGVPVKASMIPTPMFQPQVYSAGLPSPASLYGTALYPKYDESFSSRLFHLIRHTYNIYFVTPKLMYRYNTLLQKTFGPTFPSVEEIERNVDLVLVNSNEIIEKPRPISHKIKYIGGMGKKKAKPLTEEYNNILDSAAKGVVLFSFGTQVPTKKVPIEIRRNFVAAFKKFPDFLFLWKYDNLTDDHEMFENVQNIHRVEWLPQTDLLGDDRVKAFISHVGLNSYLELAAAGVPVLSVPLFIDQHHNALNAAAREIGVTVEKDQLTVENLVNALQKLLFDPKYEKNAKMISKMMVEKPEQAEKLFVDWVEYAANNPGFHKIVNLPGAELTPFWYYCCDVILACFVFLTASLFIFWRLVNFLKCQILIRSKSKSE

SEQ ID NO: 7157 - protein, 523 aa, Spodoptera exigua
MSHFLIVLITSCVLFSNQSESARILAVFPIASISHQVVFRPITQELARRGHEVTVITPDPAFPKGETPQNLTEIDVHDITYDIWKEKFMTAPKGNKNDLYLHIQIYLDSILLMFDAQLKDENVRNAIEDKNKQFDLVLLEAAVRPGLIFSHIYNAPVIMISSYGASFDNFEIVGAPIHPLLYPIGIRQRLNNLSIWEKITELYLHYKSDEMASSNYALENDFLRKRFGPGIPKIEELNNNVHMIFLNIHPIFEGIRPVPPAVLFMGGLHQKPEKELPKDLKNYLDSSKNGVIYLSFGTNVDPKLLPPHFIQTLINALSKLPYDVLWKWNEDELPGRTENIKISKWLPQSDLLRHPKIKLFITQGGLQSTDEAITAGVPLIGIPMLGDQWFNVERYVYHKIGQGLDMETLTEEDLTNAIKTIIRDDSYRQNIIRLRSVIYDQPQPPLERAIWWTEYVLRHGGARHLRGPAANMSWAEYLELELILVIVSILLLAITIFMIASYYIFLCAKNKFYSNQSFSIIRY

SEQ ID NO: 7158 - protein, 731 aa, Agrilus planipennis
MNIPILLLVFLKFASCANILAHFITPSMSHQSVYRNIWKELSLRGHKITVITPYPLKDPLLVNLTEIDVNFSYEIIKEAINSKKLSQEQKIDAERLLNEIIPPVLDCQLEEPRVKEIYNGENNETYDLVLVEMIYPVVYPLAQKYRCPYVGIASFSGAKVFEIALGNPAHPVAYPDVLLEYSAVETFFQRLHSTFFDIRTYLRLARVTTLRTLLVVINIRNPHTRQLNVKNAFLIGELQEEIYMKQPLGVSKQSDLILASRNRSTIFVSVNLTGDKKIYLLIYDEKVLLQITRKLGQQCRMKDLGQPNFFLDIKIERDATALRNSNCNGINTPVKPKSPSETNSESIIEIRPYRELVGCRYLIRSTRPDLSAAINFYSRFQSNAAEAQWTGFKRILQYLQATRDCCLYYPKDNPEPLALGQLEDQEAANSPTLLYGGREMGFHFTKPVTIYEDKQACIHLIKRWDHRRLKHVDVKYNFTRDLHAKGEIEDLKKELDDAIQGVIYFSLGSNVKSVNLTSRLKGVIASALSELPYKVLWKWESDHFPGKPNNVVIRQWLPQEGVLAHPNVKLFITQGGLQSMEEALFYKVPLLGMPFFGDQPSNINKMVQMGIGLEINRNTVTKEEMKLKILELINTDKYRQKIAELSDIAFDQPMTGVEKAVWWIEYVIRHKGARHLRNPLLDMPLYQYLFLDIIALVLSVLAFAIFVIVFAIKYLLKFIKSWQNSTKIKSS

SEQ ID NO: 7159 - protein, 698 aa, Caenorhabditis remanei
MVILFLLFSIVFSNLNAINVLVYSPAFAASHTNFMARLADTLTEAGHNVTFLVPIVDVARRNQLGVRITTDVVVVEHDELASQESVPFDDSMEVYWTEKTDSSNVEESFKWFFDGMEVGCENLLRQKHIFDLMKSRNFDVAILEPLAVCGLGFFKKLGIEKTILASSCAYYDFLFRHLGEPNEYSYLPALMSTKGEKMSLMERFENYKVSEVQKVFQGMSRGMFKMFDKEQHFYRQYLGKEIPDWRELIPAASLYFTNSNPYLDFPRPVIQKTIPIGGVTVDMEKIKSTKLDSDWDTILSKRRLNLLISFGSMIHSSHMLTPARDNILRVIASQPDVTFIWKYETNDTSFAENLENVVFSQWVPQTALLADTRLSGFLTHGGLGSTNELAHLGKPAIVVPIFGDQYRNAHMLERHGCALIVEKTELDNWKLLKNSVKSILYDGKFKKNAMHLAELLRNQPLKPKELVVKYVEFVAKYGPFPEMDPYVRKLDFIQRNLLDVYLIEIIGHILFFSVIFLMTYLMPVIDIGKRDECIGVKLTKDLVIVEASEEMIARKKSESTSDEMMEAWWKSEMDSTNLRDTFRTNKDSFQMFKWFSSDMKIGCRNFHSRRDIFHQMKSRNFDVAILEPISVCGLGFVNALGIEKIILASSATFFDSVLNYIGEPLDFSYVPSLYSVTGEVMSMAERYENWVVLAFGTR

SEQ ID NO: 7160 - protein, 518 aa, Amyelois transitella
MAKTAYLLVAALALAHVCDAYKVLVMFPMVGKSHQILAGGVVRALLDAGHEVTQVTPFPDKNLPPNLRQVDISGSVDDQFVKMLNVTALLEKEVKMGLSSMKGFIEVMNKIVLSDVNMVKLMSDTTETFDVVIAEWMFCDTYAGLGPVFDSPLIWFSSIEPHWIILSLIDESVNPAYVPDSMSSNVPPFNFVNRVKELFYQAMGLVFKFLFIDSFQSEQYEKLLVPYIAKRGKPVYPFDVVKYNASLFLGNSHVSLGLATRLPQAYKPIGGYHIDPVVKPLPNDLKNILDNAKNGLIFFSMGSNLKSKDFPEVLKKEFLQIFGGLKQTVLWKFEEKIPNLPSNVHIVDWAPQQSILAHPNCIIFITHGGLLSTTEAVHFGKPIIGIPVFGDQFNNIDRAVKKGFALRVDLAYDMKEHLRDAIELLLHDKRFTETAKELSLIYHDRPVHPRKELVHWVEHVVKTRGAPHLRSPALDVHLYQKLYLDLLALVLAVLYVLKKIIVKLCCSRKKVDKKVKKN

SEQ ID NO: 7161 - protein, 520 aa, Amyelois transitella
MIRIIVFLVCALSIDAARILFVIPTPSISHQLPIRPLTLELAKRGHNVVVITTDPIYPKGSAPVNFTEIDLHEISYKIWREKVLIATTSKGSSDDLEHQITLMYNLLTDIFEVQMETAEVKTLIKDKTKKFDLIFLEALSRPALLFSHIYKVPVILISSFLSMYNNLDVLGAPSHRILYPEITRQKINNISQWEKAKEMYMQHKLEKIINDAEVKQNAVIKKVLGRDAPTIDMLYNNVDMLFLNSHPIWDSNRPVPPSVVYLGGIHKNPRKDLPKDLKAYLDSSKHGVIYISYGTNVSPSALPAEKIQMLARVFSRLPYDVLWKWDKDDLPGKPKNVRISKWLPQSDLLRHPKLKVFITQGGLQSTDEAIDAGVPLIGMPMLGDQWFNVENYVKHGIGVRLDMDTLTEEKFQNAIEKVINDQSYRQNIIKLRDLINDQPQSPLERAVWWTEHILRHGGGRHLRSPAANISWTQYYEVELIAYLLAGLLLVLVIFATVIIYTVRFVSQIINSNSKLKSKEL

SEQ ID NO: 7162 - protein, 533 aa, Ailuropoda melanoleuca
MAAGSRGPRPLVLGLLLCALSPTVSHGGKLLLVPVDGSHWLGMLGVIRQLHQRGHDIVVLAPEASVHIKEAAFYSLKRYPVPFRREHVEATFIRLGHGVFENEPLLQRVVKTYKRVKEDSALILSACSHLLHNKELMASLVESSFDAVLTDPFLPCGPIVALYLALPAVFFLNALPCGLDSQGTQCPSPPSYVPRPLSLNSDDMTFLQRVKNMVIFLSENFLCNVVYLPYGPLASEILQKDVTVQDLLGSGSVWLLRSDFVKDYARPIMPNMVFVGGINCASKKPLSQEFEAYVNASGEHGIVVFSLGSMVSEIPEKKAMEIADALGKIPQTVLWRYTGTPPPNLAKNTRLVKWLPQNDLLGHPKTRAFITHSGSHGIYEGICNGVPMVMLPLFGDQMDNAKRMETRGAGVTLNVLEMTSEDLANALKTVINDKSYKENIMRLSSLHKDRPIEPLDLAVFWVEFVMRHKGAPHLRPAAHDLTWYQYHSLDVIGFLLAVVLGAVFIAYKCCVLGCRKCFGKKGRVKKSHKSKAH

SEQ ID NO: 7163 - protein, 256 aa, Diuraphis noxia
  MOD_RES (52)..(52): Any amino acid
  MOD_RES (143)..(143): Any amino acid
TPNVVYVGGIHLKPAKTIPKDILDFIEDSPQGVIFLTFGSTIKVSSFPEHIXKSFKEALADIPQRVLWKYEGEMKDKPKNVMTRKWFPQREILLHPKVKLFISHGGMSGVYEAVDGGVPVLGIPVFYDQPRNIEHLVLAGMAXSMDLLSTTREKLSNAISELINDERYAKNAKIASDRFKDRPMTPQQTVVYWTEYVIRHKGAPHLRSHALNLTWYQYILLDVMAVVLVFVFLVTFVLFKVFKCIKGFRNDKVKTQ

SEQ ID NO: 7164 - protein, 530 aa, Mesocricetus auratus
MALAGSPASLPLCVCLLLASDFVQAGRLLVVPMDGSHWLTMKMVVEKLVNKGHEVVVVVPEVSWQLGKSMNLTVKTYSISHTLEDLNREFKYFSDTQWKTPEQSMLSLMTGTAKGFFEIIFSHCRDLFNDKKLVEHLRQSSFDAVFLDPFDVCGLTVAKYLSLPSVIFARGVFCHYIEEGAKCPSPLSYVPRILLKFTDTMTFTERVWNHISYMLEHAICPYFFKTASEIASEVLQTPVTMEDLFNQVSIWLLRTDFVLDFPKPVMPNMVFVGGMNCQQRKPISQEFEAYVNASGEHGIVIFSLGSMVSEIPEKKAMEIAEALGRIPQTVLWRYTGPKPSNLAKNTILVKWLPQNDLLGHPKTRAFITHSGSHGIYEGICNGVPMVMMPLFGDQMDNAKRMETRGAGVSLNVLEMTVDDLENALKKVINDKSYKENIMRLSRLHKDRPIEPLDLAVFWVEYVMRHKGAPHLRPAAHDLTWYQYHSLDVIGFLLAIVLTVVFIVFKCCAYGFRKCFGKKGRVKKSHKSKTH

SEQ ID NO: 7165 - protein, 527 aa, Peromyscus maniculatus
MAMGLQVSLLLLLCALPWAEGGKVLVIPVEGSHWLSMRTIVRELHARGHETVVLAPDASVYIKAEDFFTLKTYAVPYTKEEYAHHLLSLLQMFFEIEYSVMMVLNNMELMKNVSTFYQRTCTSLLYNKGLVQHLNSSSFEVVLTDPANLCGALVAKYLNIPAVFLLRFIPSEVDFEAAQCPSPPSYVPRLFTSNSDHMSFLERVKNVLYPLPFKIIFRSSFAFYESLASELLQREVSLMEILSHASIWLFRFDFVFDYPRPIMPNMFFIGGMNCVLRKPLSQEFEAYVNASGEHGIVVFSLGSMVSEIPEKKAMEIAEALGRIPQTVLWRYTGPRPSNLAKNTILVKWLPQNDLLGHPKARAFITHSGSHGIYEGICNGVPMVMMPLFGDQMDNAKRMETRGAGVSLNVLEMTADDLENALKAVINDKSYKENIMRLSRLHKDRPIEPLDLAVFWVEYVMRNKGAPHLRPAAHDLTWYQYHSLDVIGFLLAIVLTVVFTVFKCCAYGCRKCFGKKGRVKKSHKSKTH

SEQ ID NO: 7166 - protein, 577 aa, Rousettus aegyptiacus
MRSCTPYLVLLCGAVGMARAAKIVIVPPIMFESHMYIFRTLAEALHERGHRAVFLLSEGRDLAPSPSYGLHRYPGVFNSSASDAFLQAKMRSIFSGRPTALELLDILDHYARNCDMMLADRGLVRALLRERFDLLLVDPNDMCGFVMAHVLGVQYAVFSTGLWYPAEVGAPAPLAYVPEFNSLLTDRMSLLQRMKNAGVYLVSRLGVSLLVLPKYEHIMRKHRLLPATSMPDLVQGSSLWLLCTDVALEFPRPTLPNVVYVGGILTKPAGPLPQDLQSWVDDADEHGFVLVSFGAGVKYLSEDIATKLAGALRRLPQKVIWRFSGTKPKNLGNNTKLMEWLPQNDLLGHSRIKAFLSHGGLNSIFEAMYHGVPVVGLPLFGDHYDTMTRVQAKGMGILLEWKVVTEDTLHAALVKVIGDPSYRQSARTLSEIHRDQPGHPVNRTMYWLEYVLRHRGAPHLRAAVHELSFCQYFLLDVAAVLALGAAALHLLLSRGAALARRTLRGWWSARGHSAANGHPHNGVLNGRCHGGRPAKHVKKAHVLVAVPHARLHRAMGISVQPPRDSGHWTLRPPLLRL

SEQ ID NO: 7167 - protein, 515 aa, Halyomorpha halys
MKIWMLSLLLVAHAEAARILGFFPLASKSHHYFFRPIMEALGKRGHEVVYYTGYPMKAVPPGVVQVDISGDLPDVHSTINVMDFVDTGVIYNVKNLFGFSLYMASFVMESPAVQKLVQSDEKFDAVLIESYFVQEYLSAFIHKFNAVGIDIMSLGDSAWANELTGLSDNPSYQIGFIAELTQNLNFWQRVYNTYVYAVTTIGGYYYMNEMEKLVDKYFTYTGHESRPSFMQMVSNRSLILTNYHNIVGYPGPKPPHRKDVAGVHITPGKPLPKKIQKFMDDAESGVIYFSLGSNVNVSHPANRKLVEVFMKVFEEVPQKVLMKYELATYEGNLPENVHLEKWYPQPDVLAHNNTVLFITHGGYLSLVEAVNFGVPVIGIPFFGDQGKNFRFVEEVGIGKMLRLADINYDNVSRMVKEVLSNRTYKEKMIKRSKIFRDRPVKPLDEAVFWIEHVIKYPEVLKPKALSLSYIQLHLIDVTLFVIGVFLAVMFIMWKSITIFVRILKRKSTPKKEKRS

SEQ ID NO: 7168 - protein, 520 aa, Leptinotarsa decemlineata
MLYRTALLFIIFSSLDHAESARILVSIFSPSFSHNVVFRPIWKELAKRGHDITLLTTDPMRDPKLKNIREIDLSGSYEIMEKYKASELLTKGKNEGKNTVKLIVDYLNALDHTADWQLEQPEVKQLIQNTSEYFDLVIVEVMNPIQMAFAERFKVPFIGITPVDAPYRIHAALGNYMHPSVYPDYFLPLIPPLSLLQRIVSCGVNWANWFLQYYTRYPAEDLIVRKHFGEGLRDLSEIEKDMSLLFIYVNPVFYQMRPVGTNTIVIGGGMHVNKPKPLPKELREFIESNENGAIYFSLGTNVKSSLMTDNMKSVIISSLGNLPYNVLWKFEDDSIQSLPKNVKIVKWAPQQDVLGHPNIKLFITQCGLMSIDEAIYNHVPMVGMPFMGDQGYNAVILEKKRLGKRVDRMNLTEEDFTKSIIEVIKNPIYKKNVVEMDMLTKDVQTTGLEKAVWWTEYCIRTNGAKHLRSPVIDTPTYQFYYLDVIGICLTVLASAIAIGLIAIRFLLGLLCRRDSKKKTE

SEQ ID NO: 7169 - protein, 214 aa, Ostrinia furnacalis
MIDAVSKLPHNVIWKWNQDELPGTISKIRISKWFPQSDLLRHTKVKMFITQGGLQSADVAITDAGVPLIGIPMLGDQWFNVEQYEYHNIGIKIDMDIISEEKQRNGIETVMKDKSHPKIKLFITQGGLQSTDETITDVSTAAGKPVRCRMFPWCRFRAVCAFQHPPCMDQAACERRGCMYEHKTLPAQSAPPAQAPSPMDVTSSIDVASPMDVA

SEQ ID NO: 7170 - protein, 526 aa, Acromyrmex echinatior
MSLSVFFVILAFDQIATSYRILGLFPLNGKSHWNMQEVLMKELARRGHQVDVVSHFPLKKPVPNYKDISIKGTLPEVTNNMTATQALSFSTPSMATLIQLVGTTSCNLFSYPKIQELIKNPPQDPPYDLVILELFAAPCYMAFGRHLKVPMVATVASVFHDWLSEMSANPMNPSYIPHMFSGYSQHMNFKERLTNFLVIHYLSWQFHYYTNAEQLKLINEHFGMNLQHITDLYNDVSLYLVNSHNSLNGIRPMTTNVIEVGGLHLSDEGDPLSPEVQKWLDESKDGCIYFSFGSMVRIETFSKELLQQIYASFEKIAPVRVLMKIVKKEELLPGLPKNVMTQSWFPQIAVLKHKNTRAFITHGGLHSTQETIYCGVPMIGIPLFGDQRVNIKNYVNKKVAISLNSINNVTEENLTLAINNILKDSSYRENIQKLSKLFLDRPMKPLDTAIFWVEYVTKFRNVLQSPGIKLNWWQRNLVDIYVFIFTVISIVFYIALFILRKLMKLLFGSRTCAKKDNAAMKLKKNK

SEQ ID NO: 7171 - protein, 261 aa, Ancylostoma ceylanicum
MVNSNELYELPRPTLAKVINIGGIGVEYKDAKPLEGEFKKIAESGKGIVVMSFGSVAHAELMPEHWKTAFLKAFAHFPDYEIVIRYGSDDLKDRLPPNVHAHRWLPQADLLLHPNTKVFISHGGYNSLQESINSGVPLVTIALFGDQFKNSKIAAKHGFAVNLKKGTLDEASIVAALKEVLNNEKYSLNAKRLSLMVRKKPVSPTHLLVKWTEFLAEFQTLENLTPAGNSLNFFQYFSLDVIGALLLVVQKGEERMTWFMR

SEQ ID NO: 7172 - protein, 533 aa, Vicugna pacos
MTTGSWGPRPLVLGLLLWALGPTMSQGGKLLVVPVDGSHWLSLVSVIRELQQRGHDIVVIAPDASTHIKEGASYTLRKYPVPFQREELEKIFITLGRNVFENDPFLQRVIKMYQKVKEDSALLLSACSHLLHNKELMAFLAASNFDAVLTDPFLPCGPIVAQYLALPAVFFLNGLPCSLDSLGTQCPNPPSYVPRPLSSNPDHMTFLQRVKNMLVALSENFLCSVVYSPYASLASEVLQKDVTVQDLLKSGSIWLLRKDFVFDFPRPIMPNIVFIGGINCASKTPLSQDFEAYVNASGEHGIVVFSLGSMVSEIPEHKAMEIADALGKIPQTVLWRYTGTPPPNLAKNTKLVKWLPQNDLLGHPKTRAFITHSGSHGVYEGICNGVPMVMLPLFGDQMDNAKRMETRGAGVTLNVLEMTSEDLEKALKTVINDKSYKENIMRLSSLHKDRPVEPLDLAVFWVEFVMRHKGAPHLRPAAHDLTWYQYHSLDVTGFLLAVVLTVVFIAFKSCVFAYRKCFGKKGRAKKTHKSKAH

SEQ ID NO: 7173 - protein, 368 aa, Caenorhabditis remanei
MDYLEIKAFALAHTVAFEASSMRVLGESVMPSHVPDLLTPSSDRMSLYERLLNSAIQTLHSYYRLTPEYYTSYSNPEERIYPLERLPDASFVFTNSNPYLDFPRATIAKNIQIGGISVSMETRKLGEEWDQILNLRNKNFLIAFGSVILSKDMPFESKVSLARAMKQFPDVKFIWKYEDSDTDKFAEGIQNIHFTKWVPQRELLADARLSAFMTHGGLGSVNEVSYMGKSSIMCPIMGDQMRNTKMLVRHNGSIEISKYDLGNSELVEKVIRKILYDESYKIAAQLLSDHLMNQPVSPKDLFLKHTEFAARFGKLPSLDPYSRQMGFMEYFMIDLVLIVTVIVVVLCLLLYFLLKLVYRISGKRMKVE

SEQ ID NO: 7174 - protein, 533 aa, Lipotes vexillifer
MTAGSQGPCPLILGLLLCALGPALTQGGKLLVVPIDGSRWLSLVRIVQQLQHKGHDIVVLAPDASMYIKEGAFYTLKRYPVPFRREDLEVAFINLGRSVFENDPFLQRMVKRYKKIKDDSALLFSACSHLLHNEELMSSLAEGSFDAVLTDPFLPCGPIVAQYLAVPAVFFLNGLPCSLDFQGTQCPNPPSYVPRPLSFNSDRMTFLQRVKNILIALSESFLCNVVYSPYAPLASEVLQKDVTLQDLMSYASIWLLRSDFVNNYPRPIMPNTVFIGGINCASKKPLSEEFEAYVNASGEHGIVVFSLGSMVSEIPEEKATEIADALGKIPQTVLWRYTGTPPPNLAKNTKLVKWLPQNDLLGHPKTRAFITHSGSHSVYEGICNGVPMVMMPLFGDQMDNAKRMETRGAGVTLDILKMSSEDLEYALKTVISDKSYKENIMRLSSLHKDRPMEPLDLAVFWVEFVMRHKGAPHLRPAAHDLTWYQYYSLDVIGFLLAVVLTVIFITFKGCAFAFRKCFGKKERVKKSHKSKAH

SEQ ID NO: 7175 - protein, 531 aa, Equus asinus
MAPAVLTGFLPLCVCLLLTPGFADAGRLLVVPMDGSHWFTMRSVVEKLIHRGHEVVVVVPEVNWQLGKLFNVTVKTYSTSYTLEDLNHQFRIFSKAQWKARVQSLLSLLMISSGSSFFEYFFSHCRSLFNDAKLVKYLEENSFDAVFLDPFDMCGLIVAKYFSLPSVVFTRAPFCHHLEVGSQCPGAPSYVSRFLSGFSDAMSFTERVWNHILYLEEYLFCRYLIRTVLEFASEIFQKTVTEYDLFSHTSIWLLRTDFVFDYPKPVMPNVIFIGGINCHQGKPLTKEFEAYVNASGEHGIVVFSLGSMVSEIPEKKAMEIADALGKIPQTVLWRYTGTPPPNLSKNTILVKWLPQNDLLGHPKTRAFITHSGSHGVYEGICNGVPMVMMPLFGDQMDNAKRMETRGAGVSLNILEMTSDDLANALKTVINDKSYKENIMRLSSLHKDRPVEPLDLAVFWVEFVMRHKGAPHLRPAAHDLTWYQYHSLDVIGFLLAVVLGVAFIIYKSCAFGFRKFFGKKGRVKKSHKSKTQ

SEQ ID NO: 7176 - protein, 521 aa, Spodoptera litura
MSHFLIALIASCVLILNQSEAARILGVFPVASISHQVVFRPITQELVRRGHTVTVITPDPAFPKGETPQNLTEIDVHDISYDVWNEKFMSISKGKKSDLYQHIERYLESIVYMFDAQLQDKNVRNLIEDKSKQFDLILLESSARLGLIFSHIYKAPVIMISSYGGSFDNYDVVGAPRHPFLYPICVRQRLHNLSLWEKITELYLHLRSEEMAASNYAKENAILRKHFGSNIPKIEELNNNVHMLFLNINPVFEGIRPVPPTVVFMGGLHQKPVKELPKDLKNYLDSSKNGVIYLSFGTNVDPTQLPSDFIQTLINALSKLPYDVLWKWNGDELPGRTENIRISKWLPQSDLLRHPKIKLFITQGGLQSTDEAIIAGVPLIGIPMLGDQWFNVEKYIYHKIGLGLDMETVTEEDLINAVKNIIHDESYRQNIIKLRNAMHDQPQSPLERAVWWTEHVLRHGGARHLRGPAANMSWAEYLELELVFTLLFTLLVVITILIVSLRFMLKALHQRVNQYIKLKQS

SEQ ID NO: 7177 - protein, 394 aa, Mus musculus
MDFLKNENFDLVLLDSMDLCSLLIVEKLGKRFVSFLPFQFSYMDFGLPSAPLSYAPVYGSGLTDQMDFWGRVKNFLMFLDFSMKQREILSQYDSTIQEHFVEGSQPVLSDLLLKAELWFVNSDFALDFARPLFPNTVYVGGLLDKPVQPIPQDLENFISQFGDSGFVLVALGSIVSMIQSKEIIKEMNSAFAHLPQGVLWTCKTSHWPKDVSLAPNVKIMDWLPQTDLLAHPSIRLFVTHGGMNSVMEAVHHGVPMVGIPFFFDQPENMVRVEAKNLGVSIQLQTLKAESFALTMKKIIEDKRYKSAAMASKIIRHSHPLTPAQRLLGWIDHILQTGGAAHLKPYAFQQPWHEQYMLDVFLFLLGLMLGTLWLSVKVLVAVTRYLSIATKVKEA

SEQ ID NO: 7178 - protein, 498 aa, Caenorhabditis briggsae
MADIIADHGHNVTLFQPFHIAMKNIEGLVKNENIEVGSKNNLKLTNKHFRSSTTIRTNTRKTETFPMFWDSHLMNNPILQAFMMPRYLVSQLQRTAVLLDELKSRNFDVIISESIELTGFHLAHLLDLPCIPTMSAVRFSIFNKLFGQPSAMGYVPHIGSNMAPEAGLFDRLNDIFRNVLMLNWMGRMADLQQTFIENGIGRPVPHWKDLIKQSPIYITNSNPYLDFAVPTTATIVHVGGITMDLKQMKHAGKLPKEYVPILNERESTVLISFGSVIRSFQMPDNFKAGLIKMFESLPDVSFIWKYEKDDAEFEKKLPKNVHLRNWVPQAALLADGRVKVFVTHGGLGSTMEVAYSGKPALTVPIFGDQPDNAMMLARHGGAIAYDKFDLQDGEKLTRTMKDMVENRKYQEKAQELLEILSNQPIDPKLNLMKHLEFAMQFPNLRSQVPAINHVGFVAHYYLDAIAFIAVFGMLSVYGSYRLIRKLPVRFLSKKAKDE

SEQ ID NO: 7179 - protein, 526 aa, Musca domestica
MRFWNGQLLLQLFIAIAGSLHSIHGYKFLGVLHFGSKSHFIVGSALLKGLAEKGHEVTVISPFSLKKPMKNYVEIPTPSVLKLMDEELNNLLDTTERSVVENLVSFHNTGVRVTEAVLNEPAVKQLMVSNQTFDAVICEVFLSEALYGLSEHFKAPLIGLGTFGAVAWNTDMVGSPSPPSYVANTFLPFTDHMTLGQRIINLAMLSFERLFLDFYYLPKQEEVFRRYFPDSSRSMYDIRKNAALVLLNTHVSLSFPRPYVPNQIEVGGMHINRKRTPLPVAIEKFINGSRHGVIYFSMGSNIKSANLPVEKRQAIMKALKSLKQRVLWKFEDPNLEGKPDNVYISDWFPQDDILAHENVKLFITHGGLLSTTESIYHGKPFIGIPIFGDQFLNMAKAVANGYGILLDYKNITAEALQQAIETMLGDPKYTILVRAMSERYRDQPMEPLTQAIYWVEHVARHKGAKYLHCAGLDLNFIEYHSIDAILILYGGLLFVVSVVLWLLKYLLGCLLRRVAGPKVTKKQKKH

SEQ ID NO: 7180 - protein, 518 aa, Neodiprion lecontei
MEFRTVLVFLIACCATDAARILGIFPYQGRSHNIMFEPLMVGLARAGHTVDVVSHFPPKESVPGFNHISLKGSLHFYVNNITVSFTQEVKGVHNVIRFISGREPSDLCNLMRLPQLQNILNTKTKYDVMVTEVFGTNCYLAVAHKLQIPVVGVTTGVMYSWGYSPFFGDGNPSFIPSQLGSFTNEMSFLERVENTIIHFYSIFLFNYYERTVSDPLARQYVEDMPPLTDLYNNMSLMLVNSHPSIHGVRPGSPAIVEVAGLHIDETQVLSKELEEFLNSSKDGVVYFSMGTMVRSDTFSSDRISAIYESFSETPNYNVLWKGNADHLPKPFPPNVKVVSWAPQYAVLRHPKVKAFITHGGLMGTEEAIHAGVPMIGIPFAADQTFNVVGYAHRGFAIHLDYKDLNKATFSKALSEVLTNPKYQSNAAYFSRLFKDRPRSPLDEAVFWIEYIVRNGGEPLKSSALHLNWFQYYLIDVILFLLTAAAFVVIVLFLLIRKVLGIFIGTTKPSTRQRKQKTK

SEQ ID NO: 7181 - protein, 528 aa, Cephus cinctus
MFARRWKVLLLTVLISRIALCEASRILGIFPFHGKSHAIMTNALMKGLARRGHQVHIISHYPSLEPMENYTIVVNLNGTIKGIVGQFSVAGVLDDKFQSNIAMTLGTLAGNDVCELLGTDVMQNFIKSLPNSEPYDLIITEVFGAHCYMGFGHLLKLPVVGVATCLEFSWMAEMIGNPVQPALYPDAYSHLRAPLNFWGRLQNTLSVPRSKYNFQKVTQVQTDLMRKYLSPDMPDIREVEKILSLLLVNTHHSQFEARPVVPALVEVAGLHVEDKESKSSPEVQKWLDESTEGLVYFTLGSLINIETFPNATLSAIYTCFSKIAPIRVLMKITNAESLPEGLPKNVKILPWLPQVQILKHPNTKAFITHGGLMSLQEAQYYGIPLVGIPLFADQYLNVVTYVDKKMAVSLYHNEITVESLGRALNAVLHDPSYWKAAKHESIKFRDRPMSAMDTSIYWIEYILRNGGDSLKARGANVPWWQIQLIDVYATILLALLTTIYLIYLVTKYVVSLVWNAVGEVKVSKKKSS

SEQ ID NO: 7182 - protein, 514 aa, Tribolium castaneum
MLFIYLFIIVPSVSITETANILGIMPFPVKSHSILFETLLKRLAEKGHEVDYVTHFLSEKTPERYNELSIRGSLPLFHNNFSVKALKDHSVYETIKFVTTSGGVDANSAIMKTAVLQSLKNTTKQYDLIITHLFGSDAMLGFGHLFNAPIVSITTCAVLPWAHGRIANPDNPSYVPNFYTSFLPKMNLYERIENTILWIMTRIWYNYLTMAPSNRLVKDFFGPDTPSLENLIQNTSLVLVNSHFSMQQVRPTVPNFIEVGGLHIREPQPLPKDLENLVSNNTFGVVYLSMGSMVITETFEPEILQAMFDAFAELPYTVLWKASPEKFPKGLTIPENIHFKTWMPQIDILCHPNVKLFISHGGLLGSQEAVYCAVPRIGIPLYGDQEANIHKSEKLGIAIKLAYGSITKDSFLETVKRVLEDLSYRHNVQKISQIFKDRPMSPLDTAVYWVEYVIKYKGAPHLRSVGADLPWYQYYLIDVAVILLFGLFVLFLLIVYILKLIMYFMYGKQKHKVE

SEQ ID NO: 7183 - protein, 526 aa, Danaus plexippus
MYDILAAGDRRCFAPPCRNTCSIHHIVRFKGIILDNTLVPKLTYMTPLLEESKLCDCFAEERGTEKKKFNAKKLYVFITNVYLMCALCRIEAANILGIFPVPSISHQVVFRKITQGLANRGHNVTVITPDPAYKNGEAPPNYHEIDVHDISYAVIRKFYKQKAHVFGDVMTFTDIRGSFEFMKEIFQAQLETEEVQKLISRKTKFDLILIESVIRLDYLNQEEENSFLKEIFGPQCPSLNEMNKNVDMLLLNIHPMWVDNQPVASNVIYMGGIHQLSEKKLPQELQKYLDSSKNGVIYVSFGTNVLSQVFPEDKLKIIINVVSRLPYDILWKWDKDELPIKASNIKLSKWLPQSDLLRHKNVKLFITQAGLQSTDEAITAGVPLVAIPMLGDQWFNAEKYEKFGIGIKLDVKTLTTDQLSKAIETVISDESYRHNISKLRGLMHDQPEPPLNRTMWWIEYVLRHGGAKHLRSAGANMSYWEYFETELILVILLGIFIIVAGISVVGFMLTHFISKFFTTTRKLKTN

SEQ ID NO: 7184 - protein, 321 aa, Caenorhabditis remanei
MKMKDKNTCDCHLLVKIDVMKVLQQRDVLEQLKNEDFDLAITEVVDGCAYAIFEHIQVRAHITVLSCSRFDHVSDVIGQPIAPSYVPSTQSFFNDKMNIKERFLNVVTFYFGRYTFANILDKEFEMAKEILGIKRSWRVSSRFSNKLFHFNLQETMPESSFIFSNHIPVLDFPAPTFDKIIPIGGFTVKMNEKILKLDDKWDEILNRRKKNVLISFGSNSKSKDMPEEYKQSFLRVFKSMPDTTFIWKYEDPSDNIAQGLENVYISSWLPQNELLADSRVTLFLTHGGLASVMELALMGKPSVMVPIFADQGRNAQMLKRH

SEQ ID NO: 7185 - protein, 522 aa, Solenopsis invicta
MRVLPLTITWLLYLSVCEGYRLLGIFPFQGKSHFTMIERLMKGLAKKGHQVDVVTKFPLKKPYPNYTDIVTLPLNVELVNKVTYEKMKSYLDVDTTYFVGIMGGNELCELLANPKIKELVQPKNPPYDAVIIEVFGAQCFGIIAHLLKIPMIGVSTTGTLYSWLPRIIGQPENLAFVSNIILGFTTPMNFWQRLCNVLRSFYDKWYFDYLTTRVQDRLIRENFGPDMPSVRELESKLSLILANSHITLNGIQPWTPAMVEVGGLHIHAEDETLQPELKKWMDDSKDGFIYFTFGSMVMIETFPREFLRVLYTSLAKIAPVRILMKVPAPEKLPPGLPKNIHISPWIPQLMILKHPKIKAFITHGGLMGTQEAISCGVPMIGIPLYADQFLNINTYVAKNIAIRLDVSTITEKSMDAALNAILQDPLYRDTARNLSRRFLDRPLNAIDTATYWIEYVIRYGENSLRSPAMDMTWWQLSLVDVIGFLLLCATIAIVGIVFIVKFMLKLMRKNNITLYSKKLKVN

SEQ ID NO: 7186 - protein, 533 aa, Dictyocaulus viviparus
MLLLLYSFLLLLQPLESSKSFKIVLFVPDIANSQVLFNTRVAETLSRAGHDVTMLMISSLDDLKSNDVKIMQNIKVHRINASYGLTKEEINEQEGGYMYQDVSILSSRFRQHMNTVTSLLVNTCQVLEDKEFLEWLQNQHFDLAFAHMYDVCPIGLIHYAKIPSWIWLNSGTLMDFVAHYMGVPKIPSYVSPILMESSDEMNFIERIKSFIGHILSVVIWRRVFPDRETAYFRELIDPSFPDIVDIAKQCPLVMVNSNELYELPRPTLSKIVNIGGLGMEMKDVKPLPDELQRIANDSSGLVVFSFGSVAPSHKMPLTWKNAFLDAFKRFPKYHFIMRYEGTDLFDKLPANVHILKWLPQTDLLAHKKTKAFISHGGYNSVQEAIIAGVPMITIPLFGDQPKNAKVAEKHKFTVNLRKSDINADNIVNALNKLLNDESYSQNVKRLSRMVEKKPVKAEHLLVSWAEFVAEFKTLKNLVPAGNELNFIQYHSLDVIAFLLIIITLIVYISSKFLIYTFNKVYYLAISFKKQKKA

SEQ ID NO: 7187 - protein, 526 aa, Trachymyrmex septentrionalis
MKMSLSVLFVILAFDQIASSYRILGLFPLNGKSHWMMQEALMKELARRGHQVDVVSPFPQKKPIPNYKDISLKGSTPEVTNNMTATEALSFSTPSIALLVEIIGFRTCALFNHPKIQELIKNPPQDPPYDIVILEMFAAPCYMAFGRHLKVPMVGTVASAFHDWLSEMSANPMNPSYIPSLFTEHNQDMNFKERLTNFLLMHYLSWEFHYYTNKQLKLVNEHFGMNLPHITDLYNDVSLYLVNSHHSLNGIRPMTTNVIEVGGLHLSDEGDPLSPEVQKWLDESKDGCIYFSFGSMVRIETFSKELLQEIYASFEKIAPVRVLMKIAKKEELLPGLPKNVMTQSWFPQIAVLKHKNIRAFITHGGLHSTQETIYCGVPMIGIPLFGDQGVNIKNYVNKKVAISLNSINNVTEEKLTSAINNILKDSSYRENVQKLSKLFLDRPMSALDTAIFWVEYVGKFGNVLQSPGIKLTWWQRNLVDIYAFIFIVIIIVLYIALFILRKLKKLLFGSRACAKNNAALKLKKNK

SEQ ID NO: 7188 - protein, 526 aa, Stomoxys calcitrans
MRFGYKQILRLFIVIVGFLHSSHAYHFLAVLHFSSKSHFIVGSALIKGLIDKGHEVTVISPFPQKKPIKNWHDVPVSGVLEFMKNETDDLLNTLERSVMENVVSFHKTGLQVTELVLKSPAVQKLMASNQTFDAVINEVFLSEALYGLSEHFKAPLIGLGTFGAISWNTDMVGSPSPPSYVPSTLLPFTDRMTLGQRIGNLALLTFERLLLDLYYLPKQEKIFRQHFPHSQRSMLEIRKNAALVLLNSHVSLSFPRPYVPNQIEVGGMHINRQRKPLPLDIERFISESPHGVVYFSMGSNIKSKNLPFEKRQELMKALKSLKQRVLWKFEDPHLEGKPDNVYISDWFPQDDILAHDNVKVFITHGGLLSTTESIYHGKPFIGIPIFGDQFLNMAKAEANGYGIMLDYKNLSANALKQAVEKMVYNKEYTNLVKAMSARYKDQPMAPLQKAVYWVEHVARHKGAKYLHCAGLDLNFIQYHNIDAILILYGGILFVLFVVLWLLKCLLGCVFGNKSQSGKTAKKMKKQ

SEQ ID NO: 7189 - protein, 521 aa, Diaphorina citri
MNHFPFIVLLSFSFLGTLSCDKILVFLPLPIWSHQMQYEKVWTALAERGHEVTIYTKFTPKSNSTNLKHVPIRLPKIDARMKEFNPAILTSSVNEILAMLFLWDFGYEGQVEAFQSPEFKKLMASKDQYDLVITESFFAMESSVALGHRFNAPNIVICSFGIAMNSLNFFGSPNLPSFMADFRTKYTNEMTFFQRFYNFYVFFVTRIMEYVYYYPKHQALVDTYFGKDYPSLYTMLSNVSLSFMYTNLAMSAAVPLVPNLIPVGGIHLNKPGKLPQDLQQRADAAKGGFVYMSFGSVVDPTKLSEETKLGFLEVFKQLKLPIFWKIDITNDPVLNAKTLPDNVFIQKWYPQTDILAHPNLRLFITHGGISSLMEASSLGVPVLGVPFFGDQYRNMVLLRHRGYALIEPIQTLTKQSFLKNAQTMLNDPSFKQNAKKWASIANDEIVSPLERVVYWTEYVLRHKGAPHLSASSRQLTWYQMYCIDIILVILGILYAVAKLLSMCCCRSSKKHTQVSSTKKKN

SEQ ID NO: 7190 - protein, 517 aa, Apis dorsata
MKFLFAIITIACAMYDDASGARILMMTPHQAKSHYIVYEALLKRLAERGHQVVSFNHFPQKTVLPNFTDVDISSSMPHVVGTKSIKIAFQQTMLQKLGSISRISLPTCQSVLEHPELKKFLHSKEKFDVYIMEIFLSDCFIGIGHALKIPIVVGISSTMPYPWTNGILRNPENPSYIPNLLSNFSDEMNFFERAANVMYFFISKLAYRYLADRPGYEIAKKHFGDDLPDLDMLRSRISLILTNGHRAVNTPRALAPGLKELGGMHIPASGPPPLPKDLKDFLDSSENGVIYFSLGSQINISTMPNEMLMSFYEAFERVPQRILWKCTESNMPKLPKKVKSIEWAPQLSILCHPNVRLFISHGGMLSSQEAVYCGVPILGIPLYGDQHLNLAYFMKRGFALKLDYYQLSYEPTISNALNELLLNKSYKDMARKASFEFRDRLIPPLDEGVYWIEYLLRHGPDSLRTTATNLTWYQYLLLDVILAIIISIALTVFIVYKLFKLLIWNERMTIDVNKKRS

SEQ ID NO: 7191 - protein, 526 aa, Pelodiscus sinensis
MYSFTAVLLLVVSSMRLAGGGKLLVIPMDGSHWLSMRAVLDELRQKGHEITVVAPEINLFMGTSESYTMRTYSVPFTKEELDGKFLAFTETIFKEQPFPLRIIQILENAKKTSALLFTTCTHLLYNSGLMPYLKESNFDAVFTDPMLPCGQIIALHLSVPSIFFLRGIPCGVDLEAAQCPNPPSYVPRMLSSNADHMTFTQRVTNLLISSSESFLCNIVYSQFESLASDFLQRPMTMKELFSHGSIWLKRVDFVFEYPMPVMPNMVFIGGINCKEKKPLSQEFESIVNASGEHGFVVFSLGSMVSEIPMKKAQQFAEAFGTIPQTILWRYTGQPPPNLANNTKLIKWLPQNDLLAHPKARAFITHGGSHGIYEGICNGVPMVLMPLFGDQMDNAKRIESRGAGVTLNVLDMTSKDLSAALNTVIYDKSYKENIMRLSALHLDRPIHPLDLAVHWIEFVMRHKGAPHLRPAAHDLNWIQYHSLDVIAFLLAVVLVAMFISWKCCLFCCRKCFCKKGRVSKSSKTKAQ

SEQ ID NO: 7192 - protein, 1052 aa, Nylanderia fulva
  MOD_RES (60)..(60): Any amino acid
MQMIKVMFLWLFYLSVCDGYRFLGLFPFHGKSHFVMCEQLMKGLARKGHQIDVISSFPLXKPYPNYNDIINITPPLKLVNNMSYEFMQILLAGMNPVHAVATLAGNDICGNLENPEIQKLVHNPPRDPPYDAILIEVFGAQCFAIFAHLWNVPLIGISTTSLYPWLPPIIAQPESLAFVPNNCLSFKLGHMNFWQRLYNTVHTVYSKLHFYYLTRPQNEIIWKNFGPDMPSVRELESKVALILINSHITLNGIQPRTPALVDVAGLHVQDESLTLQPDLEKWINNGKDGFVYFTFGSMVMIETFPRKILNILYTSLGKIAPVRVLMKVPKPEKLPPGLPENVYTSPWMPQIAIMKHPKIRAFITHGGLMGTQEAITYGVPMIGIPLFADQFMNIDAYVARNIAVRLDINKMTEKDMDAALHAVLWDPIYKDAARNLSEKFLDRPMNALDTAIYWIEYVIKYGSNVLRSPAMDLTWWQLSLVDVFVFLLLCIIIVIIVVIYIARFLLKLINGNNHSSLHSKKKINLKMQMLKVIFLWLFCLSTCHGYRLLGLFPYHSKSHFIMFEQLMKGLARKGHQVDVISPFPLKKPYPNYNDIVKLAPPMTLINNVSYEVMQVVLSTNPVHAISIMAGNDVCMYLENPAIQELTRNPPKDPPYDAVFMELFGAHCFGIFAHLWNIPLIGVSSATLYPWLPSIIAQPESLAFVPNNCVRLASPMNFWQRLYNMVHTLYNTLYFNYFTRAQNEIIRKNFGPDMPGVRELESKVALILINSHISLHGIQPMTPAAVDVGGLHVQDEGLTLQPDLEKWINDGKDGFVYFTFGSMVMIETFPREFLNIMYASLGKIAPVRVLMKVPRPEKLPPGLPKNVYTSSWMPQITIMKHPKIRAFITHGGLMGTQEAITYGVPMIGIPLFADQFINIDVVVARNSAVKLDLHKMTEKDMDAALNAVLWDPIYRESARNLSEKFLDRPMNALDTAIYWTEYIIKHGSDALRSPAMDLTWFQLYLIDVLIFLLFCIIIIIIVVIFIVRLLLKMSGNNHSSLYSKKGINHIKFK

SEQ ID NO: 7193 - protein, 511 aa, Papilio xuthus
MKLILAVCSVLVLLTCVEIKQVNSLNILGLFPFPGKSHFFVFEKYLRELANRGHNVTVISYFPQKDKVKNYHDISLANSTKILEDVFEVKKSYWSLLRLSFALVEWGTDNCRVMLSNKNVQNAWKTTKYDIVVTEQFNSDCSLGLAHHLNLPVIGLASHALMPWHYSRFGISFNPSYASHMFLNGGTKPTLYERIERVLFDSYLRLIYKFYCQRIDQNTLAEYFNDIPPLEELGRNIKFQLVYSYFVHFGSSLYPQNVIEVGGYHIQKPKKLPDDLIKFIEESQHGVIYISFGSMLRSATTPREKIETIISALKELPQRFIWKWEEDSLPGNPSNIYLSKWLPQNDILSHPNVLAFYSHSGLLGTSEALYHGVPMLAMPIFGDQPGNAAAVEESGLGVIIEFMELTKEELLEKFKQILNPEFRMKVKLLSQAWKDRPISSIDTAIHWTEFAARYPNFTFRSPAADVPLYQYLGLDIFLILFAIPLLFIVLFLLYIFKKKFNLTSGNKSKNE

SEQ ID NO: 7194 - protein, 280 aa, Ancylostoma ceylanicum
MVNSNDLYDIPRPTLAKVVNIGGVGMQLKDVKPLAPEFQRIVDKAAGIVVFSFGSVTPSEKMPSSWKLAFIDAFKRFPKYHFIWRYVGTDLQDKLPPNVHVFKWLPQSDLLQNPKIKAFITHGGYNSVQESISAGVPLIAIPLFGDQPKNAILAERHRFAVSLRKSDISADVIAKTLDRILTDHSFSRNAKRLSQMVRKQPVSAAHLIVSWAQFVAEFKTLDNLVPAGTKLNFVQYHSLDVIAFLLSVSIMILFVLWKLLKFIIVELCCLFYRNKKEKKE

SEQ ID NO: 7195 - protein, 1020 aa, Bicyclus anynana
MSIKLLSLLCYASVLTSIESARILAVFPFPSISHQVVFRKLTLGLANKGHDITVMTTDPAFPKGDAPSNFKEIDVKDISYKKWQTSFQDDYKVDKDFDTFSQMRRSIDVLGGILKIQFETPEMQEIITNTTRKFDLILVEALMHPAIVLSHILKAPLILVSSLGGIYKNHHIMGAPTHPLLYPSIFHRRLYKLTIWEKLIELYDHFLIDYAVYLNEADETAFIRQLFGPDIPTLNELYNNVDMLFLNINPIWADNRPVPPNVVYMGGIHQSPEKELPNDLKTYLDSSKHGVIYLSFGTNVLSGMIPTDKVQMIIKVLSNLPYNVLWKWDKDELPGKSNNIKISKWFPQSDLLKHPKVKLFITQAGLQSTDEAITAGVPLVAIPMLGDQWYNAEKYVKHGIGKQLDIDALTEELFKNAVETVITDESYRKNIIRLRQLMHDQPETPLDRAIWWAEYVIRHGGAKELRPPSANLSFVEYYEVELILIVVSYRIFIIIAVVNVLKMMLKLLSLILFVSKVSDSAKILAVFPVPSISHQVVFRPLIQELANRGHEVTVITPDPAFPKGSAPPNLKEIDVHDISYRTWRNSYMDNYKADGSSTNFNVVRQKWSLLAKIVEMQLHTPEIQDIINDKNKKYDLIFLEAMIRPALIYSYIFKAPVILISSLGAILSNQKVMGLHTHPILYSSPLQKRIYNLTLSEKLSELYTFYCIELADYYNEIDENALLKNVFGPSIPPLNELYNNIDMLFVNSHPIWVDNQPAPPTVIYIGGIHRIPEKELPKDIKTYLDSSKHGVIYLSFGTNALSTTIPHDKIRLIVKVLSELPYDVLWKWDKNELPEQSRNIKLSNWLPQSDLLRHPKVKLFITQAGLQSTYEAINGGVPLLAIPMLGDQWYNAEKYVKHGIGKKINIESLTATELQNTIETIIRDERYRKNILMLRDLLQDQPESSLDRAIWWTEYVIRHGGAKHLRPPSANISYAEYFQIDVIFILLLVVLICFGIIILSMFCILKNFKLRKDIRKFKCQ

SEQ ID NO: 7196 - protein, 497 aa, Pieris rapae
MRLNVVLALVILKCVLVCKVNSYNILGVFPFLGKSHFYVYQVYLQELAKRGHNVTVVSFFPQKQPLKNYHDIDLGKDNKYFEFRHPIIVSSFHKLLSLTILQPVMGPYTCRLILEDDEVQSLLRSKQKFDLLVMEQFNVDCPLSIAYKLNAPVVGMTSGLMLPWHYNRYGVPYNPSYVSYDIFNGVSKPTFLDRIVRTISYHYIKIMQRVCSMSEDRVIADFFDDVPLIEELSRKIKFLLLYQNFVVSGTQILPSNVIEVGGFHVAKAKRLPTDLKKFIEESKNGVIYISFGTILNGSSMPRRAFDAILGALKELPHRVVWKWEKEIPDNPDFIYVSKWMPQNDILAHPNVIAFFSHCGQLGTTEAVHHGVPIIGMPITADQFSNAAAIEEKGLGVQVDLNAITKELLLEKFKIILNPRFKSQVENISKMWHDRPVSAINTAIHWTEFAARYPNFTYTSPIIDIAIMEKIEKITEYKNKDVLTFTVFCMYLHSVSAV

SEQ ID NO: 7197 - protein, 1330 aa, Papilio machaon
MRCGIIFIVCIVLASRSAECARILGLFPHIGKSHYIVFQSLLQALADRGHDVTTVSFFPIKNPPPNYKDVSLEGVADLGVEVLDLSMFEFPSVLMKIPVFSLFLKAKVEINMLGEIGLGVCDQLVRLPTLAEAMKKEYDVILTENFVSDCMMGILHVYGNKAPVIGLSSSIFMAWVPDRYGLNDNPAYVPVITCPYSTRMNFLQRLGNFIVNVYSKYWFHEYLQKEEQAMIEKHFNTKIPDLEEIARNQSILMLVNSFPILNGAKPLVPSVIEVGGMHLNHTRKVLPPMVFEPLLKTLAERGHHVTTVSFFPLKNPPENYTDISLENISEVLLESLDLSLFESNGVISKIPVLRRVLGLMFEFQPLAHFALHVCENMIQWEPLANVLKKEYDVILLENFNSDCMLGLLHIYGNTAPKIALSSSNLMPWSAERIGLIDNPSYVPMVSTGFTSRMTYTERLENSFLSVFYKLWFYKSVQVKEQSLIEKRFSKAVPDLRDLSRNYTLTLVNTFHALNGVRPLLPALVEVGGMHLDHTLKPLTPYIEKFLNESEHGVILLSFGSLIKTSTIPKYKEDMIVNALAKLKQRVIWKFEGSGEEGTLTGNILRVKWLPQYELLQNKKVVAFIAHGGLLGMTEAISAGKPMVVVPFFGDQPANAAAAAAAGFATVVPYIELTEEKLTKALEFVLSAETRLNARRVSSIWRDRQADPLETAVYWTERVIRWGHHAQLHSPARDMPLYQIALLDVIATLVIAILIILAISWYILSKVFRLLFGRESRRRTPYVSRHMRLRQSIDRVAVIKVCVMRVYTFMIVLVALATHNAGDCARILGLFPHTGKSHFMVFEPLLRALAGRGHHVTTVSYFPLKSPPANYTDVVLEAAVQDGLSALDLSIFEKSNPLMKVPLLNTIIKNIFEIEMTVPLALATCESIIHQSSVIETLKQKYDVLIVENFNSDCMLGLTHVFGIEAPIVGISSSAILPWTYVRFGLPDNPSYIPLLTSPYTSNMTFMQRLDTFISKLYVNALYHMIQKRERDIIEKHFGVKIPDLEEIGKKQTSVLLVNTFHALNGVRPTLPAIIEVGGMHLDHSRKVLPSYIEKFLNKSEHGVVLLSFGSLLKTSTIPKYKEDMIVNALGKLKQQVIWKFEASGEEGTLTGNILRVKWLPQYELLKHKKIVAFITHGGLLGMTEAISAGKPMVVVPFFGDQPANAAAAAEAGFATTVPYNELTEERLTKALEFALSPEIQLNARRVSSIWHDRQAEPLETAVYWTERVIRWGHHAPLHSPARDMPLYQIALLDVIATLAVAILILLALSWYILSKVFRLFFGSGSKLKMN

SEQ ID NO: 7198 - protein, 521 aa, Spodoptera litura
MKIFIYLILCLSIFASHDEAARILAVFPNPSISHQVVFRPLTQELARRGHEVTVITTDPVFPEGKAPANLTEIDVHDISYDIWKKIFLASTKGNKDDVFMAMSAIVNALTAVVDVQLKDERVQNLIRDKSKQFDLLFLEACVRPALVFSHIYKIPVIQVSSFMATFDNYANIGAPIHPFLYPALTRQRLQNLTMIEKIKEFYNDFMLNRLYANNMEKENEMLRSHFKDIPPISELNNNVDMLFLNVNPMFEGIRPVPPSVVYLGGLHQVPHKPLPKDLQTYMDSSKNGVIYVSFGTNVDPTKLPADRIEVLVKTLSQLPYDVLWKWNGDVLPGRTDNIRIAKWLPQPDLLIHPKLKLFITQAGLQSTDEAITAGVPLVAIPMFGDQSFNAERYENFKIGKRLSMDSLTVEEFTNAINTVINDESYRENIVKLRTLIQDEPMSPLERAVWWTEHVLRHGGARHLRGPAANMSWAEYLELELVFTLLLGLLAIISVLFLILRSLYKIVFGSTVTSKPKKAKRS

SEQ ID NO: 7199 - protein, 1043 aa, Rhopalosiphum maidis
MFSSKMWPSSFFCSAVLCIAAFTTVTRAANILVFMPLPIKSHFRGFQPLFEELAHRGHNVTVASSFPLDRPIANYTDIGPFVNKDRERNVMDLIHMNFVTSVQVKWSLGVKLSETVMSNENMKRFMQQSSSYSFDLVMIETFCQEYTVAMGHKFNAPVINLAPAMLWVSVSKWLHVPSTFSYIPDVCLQTAGNMGFVERLKNTITGLMQSYVENYLYLPKMKEVMNTYFKYEGWEFRPPLEHMLNNVSLTLVNSNFAIGVARPYFPGIVEIGGMHIKNPKSLPENLQTFLDDADEGVIFFSFGTVVNLNDLPKEKLNIFLSVIQKLKQKVILKWIPNDSVQLSKNIMTGSWFPQNDILAHPNVRLFITHGGLHSIEETVSNAIPIVGVPFFADQYLNMKIVEQKGFGKLVNFFEMTEESFENAIKEVLLNVMFKEMAKIQSQVFKDQPMKPLDRAVYWVEYILRNGGAEHLKSDSLELNDVQYFLLDISLISLVLTGLIIWLCSLVVAQIISKNKIQHITIRVKMYFVVLAAVCRLTLPLLLLPAVLSPPTALAANILAFMPMPLKSHFGGFQPMFEELALRGHNVTVVSAFPLTGRRVPNYTDVDVMPPQGVPAFDVMHLVNSNFMISVTNRWFFANLLSNQMEHPNLKAFVRSEDNSFDLVIIESFLQEYTVAIGHKFNAPIVNLSPSMVWVSASKWLHLPATFSYVPDCCIGVTDDMSFVERIKNTIVGLMEMFVEDYLYIPMIKTLMSKHFSYAGWQSRPTLEKMLNNVSLTLMNAHHATGVCRPYPPGVVEVGGMHIKEPKPLPKGLQDYIDSASYGVIFFSFGSIVNLSNLPKEKLNSFLNVISRLKQKVIIKWVPDKSIKLPHNVMVGSWLPQNDILAHSNVKLFITHGGLHSIEEAVYNGKPVIGIPFFADQLSNMRLVEKNGYGRMITYDKLTEESFGKAVEEVLKNPTFKEKSMIQNQVYRDQPTKPLDRAVYWIEYVIRNDGAKYLKSDSLGLNTAQYFLFDVTLFLILLTAIITWLGYRGIVKVLSKCIAN

SEQ ID NO: 7200 - protein, 523 aa, Galleria mellonella
MWFKTPCVVLFLIYCNHAVHGASILALFSSLSFSDHLVYRGYISLLTQKGHSVAVMTPYPGNFQYPDTERIIELDVGQESAPFWDEYRRLMSNVDDYFPRLRALNELSLKIAIAQLKSKQMTALFINPNIKFDLVITEADVPLLYAVAEKYKVPHISITATNGKIHQYEAKGNPIHPILYPDVNTLNYKNLTRWQKIVEFYRHIQTKNEYYNNYLPLSEIAAKKILGLKRDLQEVEYDIDMLFIASNPILVGNRPTVPAIIFVDRMHIKPGVSLPQNIKSFLDSSTKGVVYFSLGVVQEAEQLATPILHTLAEAFRELPFTVLWKIGNTTMINKADNIIAQAWFPQQEILAHPNVKVFITQGGTRSLEEAIYYGVPIIGLPVVRSRKLFIKEVTKFGAGEVLDPYYLDKETFKSTISAVATNEKYKKAIVKLKDMIFDPVISGPESAVWWTEYVLRHKGARHFRSPAVGITFFKYYMLDLLSYLLAGCLFVLYLSFLILRYIYRRLRLRFATKPNLGTKYKAL

SEQ ID NO: 7201 - protein, 521 aa, Trichoplusia ni
MRVFVYILFLSLLFILNINEAARILVVVPTPSISHQVVFRVLTQELARRGHDVTFITTDPAFPKGGAPANLTEIDLHDLSYNLFTEEINKVPRGNKEDMITMFRAFFKFWPTVFGEQLKDASVQRLIKDKNQKFDLLILEAGIRQTLVFSHIFKAPVIQMSSFGGYLDNFPTIGAPTHLFLYPTVLLQKIHNLTMYEKIMEVYKHYTVDSLYYESRHLEDKVLREIVGPDVPSVTELANNVDMLFLNVNPVFVGIRPVPPTVVFTNGLHQIPPKELPKDLKSYLDSSKKGVIYISFGTNVDPTLLPAERIQVLVKAFSQLPYDVLWKWNGDELPGRTENIRISKWLPQSDLLRHPKIKVFVTQGGLQSTDEAITAGVPLIGIPMLGDQWFNVEKYLTHNIGVGLDLDDITVESFKNTLLKVIQDDSYRQSIVKLRRLMRDEFQSPLERAVWWTEYVLRHGGAKHLRSPAANISWAEYLELELVLTLLAGLLVVVSAFIFITYKLFKFISKKCLISVKVKSS

SEQ ID NO: 7202 - protein, 522 aa, Danaus plexippus
MANLHPVLFLIFLTKLSDSANILYVMPFSATSHYIMLKPIGTELARRGHNVTVITSIRDNNPPPNYHQILVNDTKIWDLLGIERPVVFSMVDLSTEELYNKIVWPGLIAFTELTFKSREFMTFLKKDNAFDLVISEQFYHEALYALAYKYNAPLALVTTFGNCMRHNYITRNPLQMATVTSELLVVEDPTSFWGRLRNLLFNVYDYTFWRYWYLEEQEKLVRKYLPELTGKVPSLYEMQKETALMLINSHFSYDTPAAILPNIVEIGGLHFTKSNLSLPEDLQKVLDEAQEGVVYVNFGSNVRSIELPVEKKNAFLNVFRQLKQTVLWKWEDDVLDDKPSNLFTRKWFPQKDILQHPNIKVFVSHGGLIGMQEAIINGVPVVGVPVFGDQFNNVLLAQEAGFGKLLRYHDINEKTLSAVLNEVLYNASYMETAKEVSRRFLDRPLSPMDTAIYWLEYVIRNKGAEYLKNPARNLSWIAYNMLDVYSFIAIILIVIMCVFIKSWFCIKASITFKQISKSKKQS

SEQ ID NO: 7203 - protein, 484 aa, Dasypus novemcinctus
MDRISQILQDYGHDVTMLKQDALLMSEFKEEEKSYHIIHWNLPEDFKKEFMKYFNFFMEEALHDRLTFEHFLKFMGQLGTQCNHFLRRKDILESLKNENFDLVVAETFDCCSFLIAEKLGKPFVSVISSSFGVVDFGLPRPVSYVPVFNSLLTDRMDFWGRVKNFLMSFDFSVKQWRIHSQYEEAIREHFPEGSRPVLSHLLLKAELWFINSDFAFDFSRPLLPNTVYIGGIMAKTSKPVSQDFENFIAKFGDSGFVLVALGSMSSTYQSQEILREMNSAFARLPQGVIWKCKTSHWPKDVKLAANVKIVDWLPQSDLLAHPSIRLFVTHGGQNSIMEAIQYGVPMVGIPFFGDQPDNLVRVEAKNFGVSIQLKELKAEILVLKMKQVMEDKRFRSAAVAASIIRRSHPLSPAQRLVGWIDHILMTGGSAHLKPYAFQQPWHEQYLLDVFAFLLLVTLGSMWLCGKLLGMVARWLCGARKLKQA

SEQ ID NO: 7204 - protein, 533 aa, Bombyx mandarina
MYCAFQREITKKMIRIIVIIMLLIRILQGTQAARILGVFPTPSISHQVVFRRLTLELHKRGHELVIVTTDPMYQKGEAPQNYTEIDVHDISYTTWRNDFMKLSRGSSDDLFEQTAVILELTTNLFEMQLKSKEVQALIKVKDAKKFDLLLLEACIRPAIILTHIFDAPAILVSSFGGVEYVFRILGVPTHPVLYPPPLHQRIFNLTFWEKTHEIFTHYYLEYLFWKAEYKVDEMVKRIFGPSTPTVRDTYKNVEMILLNAYAVWENNRPVPPNVVYVGGLHQKPEKDLPGDLKEYLDSSKHGVVYISFGTNVEPSLLPPERIQLLIKVFSELPYDVLWKWDQDELPGKSENIKIAKWLPQSDLLRHPKIKVFITQGGLQSTEEAITAGVPLIGIPMLMDQWYNVEKYVQLNIGLKLDLGSITEDSFRNAINTVTGDESYRQNVARLRSQVFDQPQGPLERAVWWTEHVLRHGGATHLRAAGALKSWTEYFELNLIAVLLVSFLMAIAFIVTLISSLMTSLKMYFNYDDKIKKH

SEQ ID NO: 7205 - protein, 413 aa, Erinaceus europaeus
MAKKWASLLFLLQLYCCFSCGSSGKVLVWPMEYSHWINLKTILDELTERGHEVTVLTSSASILVDPSKQSAVKFEVFTTSFTKDKLDSIFMTLIKMWTYELPKSSLWFETFNKKKWDRFFTEVLGRPTTLCELMGKADIWLIRTYWDFEFPHPYLPNFEYVGGLQCKPAKPLPKEMEEFVQSSGEDGIVVFSLGSMVETLPEERSNMIASTLAQLPQKVIWRFDGKKPATLGPNTRLFKWIPQNDLLGHPKTKVFVTHGGGNGIYEAIYHGVPMVGLPMFVDQPDNIAHMEVKGTAVRLDLNTMTNTDFLNALKTVINDPSYKENAMKLSRIHHDQPVKPLDRAVFWIEFVMRHKGAKHLRPAAHDLTWVQYHSLDVIGFLLACVAATVYIITASCLFCFRKCTKSGKRKKND

SEQ ID NO: 7206 - protein, 516 aa, Trichoplusia ni
MHILYLLTCLFFTKTSEAARILGVFPTPSISHQVVFRRLTQELAKRGHDVTVITTDPAFPKGEAPANLTEIDVHDVSYQLYVQYAANVPRGHANDMRQQIEKLISFNVEAVDKQLSAESVRRLIEDKNQKFDLLIIEARVRPALAFTYIYDAPVILMSSLGALFHNSEAFGIPTHPILYPTVNRQRLNNLTMWEKITESYTYYIVQKLFYDSIRLEDKMLQKHFGSNIPSVTELYNKVDLLFLNMYPVFEGIRPVPPNVIYMGGLHQNSEKELPQDLKSYLDSSQNGVIYMSFGTNVDPTMLPADRIQVLVEAFSQLPYDVLWKWNGDELPGRTENIRISKWLPQSDLLRHPKLKLFVTQGGLQSTDEAITAGVPLIGVPMVADQWYNVEEYVYHKIGLRLDLGDMTVENFKSSILKVINDDSYRQNIIKLRGFMRDEVQTPLERAVWWTEYVLRHGGAKHLRSPAANISWAEYLELELVLTLLAGLFSIITVFVMILFALYKHFFSNNKEKCAEH

SEQ ID NO: 7207 - protein, 490 aa, Papilio machaon
MKLLGLILLFTLKFSNIYGARILAVFPIPSISHQVVFRPIIQELLKRGHELVVITPDPAFPKGKAPVNLTEIDVHDLSYTTWEKFIQRSEDTGSSWVDKLIFVLSVIEEVFEEQMISQEVANLLKQNEKFDLLLVEACVRMSLGLSHVFKAPIIQISSFGSTFKNSEAIGSPFHPFLYPSLFRYRIHDLNIWEKIAELYNELYYHYSLQLNEIHENVVMKRLFGEETPMIHELFEKVEMLLLNVHEIWDNNRPVPPNVIYLGGLHQNVKKDLPKDLQTYLDTSANGVIYVSFGTNVRPSLLPMRKIKILTEVFSELPYEVIFKWDKDELPGQTSNIRIMKWLPQADLLRHPNIRLFITQGGLQSTDEAITAGVPLLGIPMLGDQFYNVEKYEKLKIGRGLNMDTLSKETLAAAINTVIEDESYRRNIQHLRTVMNDQPMKSLDRALWWIEHVLRHGGAGHLKSAGAHVSWSEFIELDVIIVLTLFLLFYN

SEQ ID NO: 7208 - protein, 531 aa, Ovis aries
MACLAFFARVSVAVFFLALWGFALGDRLLVVPQDGSHWLSMKDITERLSEKGHEIVVVVPKVNLLLQESKHYTRRIHPVPYDQEELEARYRSFGKHHFSPRWLVTAPMVEYRNNMIVINMYFLNCQSLLRHSGTLRFLRESKFDALFTDPALPCGVILAEYLNLPSVYLFRGFPCALENTFTRTPSPLSYVPRYYTQFSDKMTFLQRVANFLVSYLENILLYALYSKYEDLAEEVLGRQVHLPALYQKASIWLLRYDFVFEYPRPVMPNMVFIGGSAAKKQGILPREFEAYVNASGEHGIVIFSLGSMVSEIPEQKAMEIADALGKIPQTVLWRYTGTPPPNLAKNTKLVKWLPQNDLLGQPKTRAFITHSGSHGVYEGICNGVPMVMMPLFGDQMDNAERMETRGAGITLNVLEMSSGDLENALKAVINEKSYKENIMRLSRLHKDRPIEPLDLAVFWVEFVMRHKGASHLRPAAHDLTWYQYHSLDVIGFLLAVTLTVIFITFKACAFTFRKCFGKKERVKKSHKSKTH

SEQ ID NO: 7209 - protein, 535 aa, Trichoplusia ni
MRIFLVANTHPNKKRETMYIYFYLLTCFTLCLKINEAAKILGVFPTPSISHQVVFRPLMLELAKRGHDVTVITTDPIFPEGGTQANFTEIDLHDESYRIWREKLMKIAASGKDDIWTFIEGLKMFPDIFEKQLNDENVQRLLRDNKHFDLLILEACFRPALIFSHIYKAPVILMSSLGAMFDNFATVGVPTHPILYPNLLRQKLYNLTMWEKITELYSIYKVQFLYARNLDYEDNLIRKYFGENTPSLAELGNNVDMLFLNVYPVFLGIQPVPPSVVFTGGLHQKPEKPLPEDLKKYLDSSKNGVIYISFGTNVDPTQLPPERIQVLVKAFSELPYDVLWKWNGDELPGRSENIRISKWLPQSDLLKHPKIKVFVTQGGLQSTDEAITAGVPLVGVPIMGDQWYNVEKYVYHKIGVRLDLEDITIENFKNTLLKVIGDDSYRQNIIKLRSLMRDEVQTPLERAVWWTEYVLRHGGAKHLRSPAANISWAEYLELELVLTLMAGLLVALTACVIIAISFYKYFLRKYRTAVKVKSS

SEQ ID NO: 7210 - protein, 265 aa, Mandrillus leucophaeus
MPNMVFIGGTNCKKRKDLSEEFEAYINASGEHGIVVFSLGSMVAEIPEKKAMAIADALGKIPQTVLWRYTGTPPSNLANNTILVKWLPQNDLLGHPMTRAFITHAGSHGIYEGICNGVPMVMMPLFGDQMDNAKRMETKGAGVTLNVLEMTSEDLENALKAVINDKSYKENIMHLSSLHKDRPVEPLDLAVFWVEFVMRHKGAPHLRPAAHDLTWYQYHSLDVIGFLLAIVLTVAFITFKCCAYGYRKCFGKKGRVKKAHKSKTH

SEQ ID NO: 7211 - protein, 285 aa, Danaus plexippus
HQIVFRKITQELHKRGHELTVLTPDPAYPKGTAPANTQIIKLKDLEIYLNSSQHGVIYVSFGTNVLSNMISTDKIDNIVKVLSKLPYDVLWKWDGKELPGKSENIRISKWFPQSDLLRHPKIKLFITQAGLQSTDEAITAGVPLIAIPSFADQWYNAEKYEKFGIGIPLDIKTFTEEELHHAVITVINNESYRRNVIKLRETILDQPMSSIERAMWWTEYVLRHREKNHFRTLASNLSYMDYFDVKFWMTIFAIIGIFLTLFVVTIAYVIKLLNKMWIYNKVKTH

SEQ ID NO: 7212 - protein, 251 aa, Leptinotarsa decemlineata
MPYVTAFTTSREDLKEFLDEADEGVIYFSLGSNVKSVNISDRVRDTLMEAFADLPYKVLWKYESDNLVNKSHNVYIRKWLPQQDILAHPNIKVFISQGGLQSSEEAISRGVPILGIPFICDQEMNMKRLIQLEVAVGVDFVTVTKEEIVDAVREIIDNPKYRQNMKKLQSLWVDQPMTSMDRAMWWIEYVIRHKGTKHLRSPTADVSWIEYLLLDVIAVLSSALVIFIFLVTVIVKFFIRFCSNEKKFKIQ

SEQ ID NO: 7213 - protein, 520 aa, Trichoplusia ni
MRFLVHLFISYIFFVNINEGAKILVVVPTSSISHQVVFRPLTQELAKRGHDVTVITTDPAFPKGGAPANLTEIDLHDLSYNMFIQETSKMPKGNKDDLLVQMKTYLRVSALIFGEQLKDGNVQLLINDKNVKFDLIIVEACFRQSLAYSHVFKAPVIQMSSFGGVFDNFATIGAPTHPILYPDIMRQKLNHLTMWEKITELYNHYMLKWIYHNNAHLENKILQEILGPDVPTVTELYDNVHMLFLNVYPVFEGVRPVPPTVVYTGGLHQNPEKELPKDLKSYLDSSKNGVIYISFGTNVDPTMLPADRIKVLVKAFSQLPYDVLWKWNGDELPGRTENIRISKWLPQSDLLRHPKIKVFVTQGGLQSTDEAITAGVPLIGVPMLGDQWFNVEKYVYHKIGVRLDLEDITIETFKNTLLKVIGDDSFRRNIIKLRSLMRDEVQTPLERAVWWTEYVLRHGGAKHLRSPAANISWAEYLELELVLTLLAGLLVILFSTSLIVYKTYQLFLKQRLTPVKVKST

SEQ ID NO: 7214 - protein, 425 aa, Papilio machaon
MFAVNLSAFLLSLVISNNEAANILALYPSPSISHQDVFRPITLELVKQGHDVTVLTPFPMFKKGEAPKNLREIDVLDVTFGIYLDHFTKAVTGSKSDLYMQFVNMTSAIHLSSAAQMNAKEFKDVINDPEAKYDLIFIEALYTPFLGISHVFKAPIIMVSSFGPYIDTYDIIGSPTHPFLYHHMYRQRLYNLTLWEKVSELTMSLRFQKVLDEAEDKNNRLLKEVFGPTTPNLSVLKNNVDLVFLNIHPIWEGNYPVPPNVIYMGGLHLSTPKELPRELKEYLDNSTHGVIYFSFGSNVRPSMLPQEKFAIFKKVFSQLPYNVIWKWDTEDFKVDSPNIKIYKWLPQADLLRHPNVKVFITQGGLQSTDEAITGGVPLIAFPMLGDQWYNAEKYEYHKIGIQLDFENLTEDKLKDAITKIVEDKR

SEQ ID NO: 7215 - protein, 1179 aa, Caenorhabditis brenneri
MFVLYDEFRPMCEKIYQDKQLHQQILELKPDGYVAEAFDFCSLYLGDHLKLNLLPMFSSIKSVPVARAIGEPSLLNYAPTLSTAYGPQQTFWDRLQDIPMVTSFYYALSSLFDRQYGQAHSLLNGDVRNWKEIVQTATFFFYNNNPYVGFPMPILEKSVEIGGITIEPATSEKVDEEFDRILNLRNSTVLMSFGTVVLSVDMPERFKNGIIAAFTSLPDTTFIWKYEETDEQKLKKLSLPANVILKKWVPQPALLADNRLSLFVTHGGLGSTLEVAYSGKPSIIVPVFGDQLFNAKMLSRHGGAIAYDKYDLADGKLLTKTIQKALSSQSMLQNSQRLAKILQNQPFSPKSNFLRHAEFAAKFGRVESLEPYHVQYNFIQAYMLDAYAMDLFNGEGEEPERNDSEEPVEMEDEELEDVELAPKGKQNNKKRKRTSSEDSSMEDNSPKGDKKKVKGPLSNTNKSINVGKDFQAVIEENEDLTNFRDYTPDREQAYWEHHGDVDTDELEQFVNEKSAKYLVPIDRVLFILMEKKMNYREAAVEIAKRNILQDGWKDDERFAFENSFTHVGKNFHQMHAAIAHRSLRSIIHYYYDSKKSITYRAFATKSITEVETLEEFEPAVEKQPAGVFENMCENCGERAEKMMWNEQMNRIECNACLIYFRNMLVPRPTSLRLVMDERFDGQIPCPDSEFTPRSIDNTERQKAIPAMRDMMKCYNRLAAPATGKTFELRKVKDLFSMDQIVRTKKSNCKRFRIPPRFLKTDLKNLPVNRSFYMGGEPIGGPSSTSNGAFDRAFDTLNGVVEKLEREINSLPLTVDVREPPEEDEEGVEVVEEAAEQGLLMVDTMATGSEDTPEDAPEVEPVAESKIEEEEVSEAPEAPETDPEVKQNESPGEPAPNSENPSEEPVKDSSESPEKSSDSSEASKGSSSEETISEQAPETTEVSQNPEESKSPEETPRSSESPEKKPKRKSLPKKKIKLSSSSINLSEMSAKKSKKSKKSTESSLNVPSSSNGTKLSGRPPGGPSMYIWHNKRKTQCQEEIEVLLDDSRRKLFEAGQHSSKIDYKQVNNWKNDMAALRERMHKPNLDMDLYPQIVYAGERTRFARDWTEEDHKNVQRLFRWYGPNFQQIADVMGNKTADQVYNFYLSNQEAIELDHEEFTRHAGKAVELADERKCQKKLGL

SEQ ID NO: 7216 - protein, 380 aa, Heterocephalus glaber
MWNSAGGLSELWRLKYSVRGLELTAVSCGSPVNQEADGPVMEAEGSTEEAKRSALEAGDDVQGEGDDWSSSKETEADLPLFISPFLFITTQEFEGYVNASGEHGIVVFSLGSMISDIPEKKAMAIAEGLGKVPQTEFEGYVNASGEHGIVVFSLGSMISDIPEKKAMAIAEGLGKVPQTVLWRYTGTPPSNLAKNTILVKWLPQNDLLGHPKTRAFITHSGSHGIYEGICNGVPMVMMPLFGDQMDNAKRMETRGAGVTLNVLEMTSDDLANALKKVIYDKSYKENIVRLSTLHKDRPIEPLDLAVFWVEFVMRHKGAPHLRPAAHDLTWYQYHSLDVIGFLLAITLSVSFITFKCCAYGFRKCFGKKEHVKKTPKSKTH

SEQ ID NO: 7217 - protein, 521 aa, Neodiprion lecontei
MDGSFTKLGTILVILAGVWITEGSKILAIFPYQGRSHNIMFEPIVIGLARAGHSVDVVSHFPPKESIRGLNHISLQGSLYTFVNNMTTTYVKSLIGTKAIEFISYQGPNDLCNLMRLHQLQEIINTDKNYDLMLTQVLGSNCYLALAHKLKLPVVNIETSTMFPWAHDPFFESTYPSFIPCQLTTFTNDMRFMERVENLITTLYSKFLFYYYDKTVSEPIARKYIDDFPSLADIYYNISMVLVNSHWSIHGARPTNPAIVEVAGLHIDETQVLTEELEVFLNSAKDGVVYFSTGTMLKSDSFSKEKILAIYNSFAELSNYKVLWKGNMDNMPEGLPTNVKMVPWVPQFAVLRHPKVKAFVTHGGLMGTLEAIHAGVPMVGIPFFGDQMLNVGGYAYRGFAVYLNYETLNKESFSEALNEVLTNPKYQSNIARVSRLFKDRPLSPLKKAIFWIEYVIRNGGETLKSSGRHLYWFQYYLIDVGLFLLTITMLAFVVLFTVSRKLTGFIWGTQNRNVSVKQKTF

SEQ ID NO: 7218 - protein, 480 aa, Caenorhabditis briggsae
MNENLQKQHRLLLPLETSSDYRESFYGNQFSEVLQEREVLDQLKNEKFDLAITEVVDGCAYAIFEYLKVPAHITVLSCARFDHVSDVIGQPIAPSYVPSTQSFFNDRMNIKERFLNAVQFYYGRYTFANILDHEFEMAKEILGIERSWRETMPESSFIFSNHIPVLDFPAPTFDKIIPVGGFTVKTNEKVLKLDEEWDEILNIRKKNVLVSFGSASKSKDMPEEYKQSLLQVFKSMPEITFIWKYEDSSDNIAKDLDNVYTSSWLPQNELLADPRITVFVTHGGLASVMELALMGKPAVMVPIFADQGRNAQMLKRHGGAAVLQKTDLINSDLVRDTLHDVLTNPRYSLFFWNSNPQNFVLCRYAKNARRVAEMLKNLPTNAKEVLVKHVEFAARFGKLPSMDNYGRHQNIFVYYFLDIITLLILVLVLVICIFKFNDNPSVIISNLTELSFDFASIAVFREFLLVVDLQKKLLGSKIFI

SEQ ID NO: 7219 - protein, 388 aa, Trichoplusia ni
MRFLVLLVLSYIIIIIGNTEAAKILVVVPTPSISHQVVFRPLIQELVKRGHDVTVITTDPAFPKGGAPANLTEIDIHDLSYNILTQEMAKMPRGNKDDLLLQVEFYLKVSASVFSEQLKDKSVQQLINNKNIKFDLLILEAIFRQALVFSHIFKAPVIQMSSLGGVFDNFVTIGAPTHPILYPTMISQKLTNLSMWEKITLLYSLYVGERIYQNNAILENKLNRELFGPEVPSVTELYDNVDMLFLNVYPVFEGIRPVPPSVIYTGGLHQNPEKELPEDLKSYLDSSKNGVIYISFGTNTDPTQLPPERIQVLLKAFSQLPYDVLWKWNGDELPGRTENIRISKWLPQSDLLRHPKIKVFVTQGGLQSTDEAITAGVPLIGIPMVGDQ

SEQ ID NO: 7220 - protein, 564 aa, Papilio machaon
MRLLSVILFLIIIKLCSAYKILLMFPVPGRSHAILGEGFVRHLLNDGHEVTYITPIIMDIIHPRLRQIDISNNFKLMPPDQMFDTRNILMNKWDIKDIRFMLFVTTNFVNGTLTHPNIQRLIHDTSEQFDAVIVEWLYSELYAGFASVFDCPLIWSSSLDPHWLVLDLIDEVPNPAYNPQHLADIVTPLGFWNRAQELWHVIHTKYFKWRLRHRENQIFNNAFASSVALRGRKLPPLNEVRYSGSLILGNSHLSAGTAIRLPPNYIPIGGYHIKENIDSLPSNLQEIADNAQNGFIYFSMGSMLKSSRIPDEMKKGLLDVFSKLNQTIIWKFEQDLPDRPKNVHIVSWAPQLSILAHPNCKLFITHGGLLSVLETLHFGVPIIGVPMFGDQHMNINRVVEKGFGMRVDLNDDVVVNMEIAIREILDNPRYTQKVKEYSFIFHDRATPPGKELTHWVSHVIRTKGAPHLRSPGNMLPWYQKLYLDLAIVMFIALYLSVKILFQIFLVTPMPVISHAILGNAFVKLLLNAGHKITHITGIPYNISHLNLRRLEIDYHFESLQVTST

SEQ ID NO: 7221 - protein, 516 aa, Spodoptera exigua
MFSRSVLSLLVIFIRINDAARILAYFPAPSISHQVVFRPLTQELARRGHEVIVITPDPAFPKGKTPKNLKEIDVHDLSYNIWNTLFEKTSTGDPDLAFQMGLVYNVMVDMVERQLSVDEVQKMLKENKKFDLLMIEACVRPALVLSQLVNAPVIQVSSFGPMTFNVETMGSAMHLFLYPNHMRQRLYNMTIWEKLVELYNIYRIEKAIGEIEEADNVMGKGLFGPDTKTISELKDNVHMLFLNIHPLWEGNRPVPPSVIYMGGLHQKPVKELPKDLKTYLDSSKNGVIYISFGTNVLPSLLPQDKIQMIAKPFSQLPYDVLWKWDKDELPGRSKNIRISKWLPQSDMLRHPKVKLFITQGGLQSTDEAITAGVPLVGIPLIGDQRYNTEKYVHYGIGVKIDFPTLTEEIFDKAINTVLSDKSYRQNIERLRRVMYDQPQTPLERAVWWTEHVLRHGGARHLRGPAANMSWTEYLELELVFTVLGIILSILVVLSFLLLKLWRCLKPTARQQKVKNN

SEQ ID NO: 7222 - protein, 533 aa, Carlito syrichta
MATGLQVPLLRLVGLLLFLSVWPWAEGKKVLVIPVDGSHWLSMREVVQELYARGHHTVVLTTEVNMHIKKEDFFTLETYALPYTQDEFNQLIKGYIKLFFGKEHFLKKFFKSMAILKNMSLVFHKSCVDLLHNKTLISHLNASSFDVVFTDPIYPCGVILAKYLSIPAVFFLRAIPCDLDFEGTQCPGPSSYVPRLLTMNSDHMTFLQRVKNMLYPLALTYICRVFIVNYASLASELVQREVSFVDILSHASVWLFRGDFVMDYPRPIMPNMVFIGGINCANRKPLSQEFESYINASGEHGIVVFSLGSMVSEIPEKKAMEIADALGKIPQTVLWRYTGSRPSNLAKNTILVKWLPQNDLLGHPKTRAFITHSGSHGIYEGICNGVPMVMMPLFGDQMDNAKRMETKGAGVTLNVLEMTSADLENALKIVINDKSYKENIMRLSSLHKDRPVEPLDLAVFWVEFVMRHKGAPHLRAAAHDLTWYQYHSLDVIGFLLAIVLTVAFVAFKCCAFGCRKCFGKKGRAKKAHKSKTH

SEQ ID NO: 7223 - protein, 520 aa, Bactrocera latifrons
MHFPSVILMITALLCAANVQAYRYLAIMPTGARSHHIVGSALMKELARRGHQVTVISPFPLKKPMENYVDIEIPTIKAVMENTASALLKTTEKTVVENVRGFYEMGLNMTRIFLEENNVKALLASNQTFDAIICEIFLSEALYGLSEHYNVPLIGLGTFGAHAWNTDMVGSPSPPSYVANSLLPFNERMTLWQRVGNFAFGIFERLLLDLYYLPKQAAIYKEYFPNNKRDMYEVRRNAALVLLNQHVSLSFSRPYVHNQIEVGGMHINRKRSPLPADLERFINESKHGVIYFSMGSNVRSKFLPVEKRKAILETFRGLKQRVLWKFEDPKLEGKPDNVYISEWFPQDDILAHPNVKFFITHGGLLSTTESIYHGKPFIGIPIFGDQFLNMNRAETGGYGIGVDYNGFTKEKFQSAIERMLNDESYTKRVADISAQYRDQPMNPLDLAVYWVEYVVRHKGARHLHCAGQDLNFIQYHSIDSMLIIFGGLTLVLLLILLLIRSVWGWLQFALARKDIKKKTQ

SEQ ID NO: 7224 - protein, 429 aa, Papilio machaon
MFPTPSISHQVVFRPLTQELAKRGHEVIVITPDPAYPKGQAPKNLTEIDVHDISYSKWKIMMGRIKDVARDIIAQLEVIINSNNAVFEEQMKTESVQEILKYKDDYFDLILVEACVRPAIGLSYVFKAPIIQRVFGENVPRIDELYDNVAMLFLNFHRIWDSNRPVPPSVIYMGGLHQNPQKELPKDLKSYLDSSKNGVIYFSLGTNVKPSDLPSDKLQAIINVFSRLPYDVLWKWDDEELPGRTKNIKISKWLPQSDLLRHPKIKLFVTQGGLQSTDEAITAGVPVIGIPMLGDQWFNAEKYVHFNIGHKLDIDTLTEEQFDNAIKSILNNNSYRENIVRLRSIMQDQPQSPLDRAVWWTEHVLRHGGARHLRGPAANISWAQYLELELVFTLAAILISSLFVLFIVAKLIWNILKVQLSAVIKVKKS

SEQ ID NO: 7225 - protein, 1018 aa, Papilio xuthus
MVHLITVIVLSISLCITLCDAFKILVVFPFPAGSHCNLGDGYVRHLLKAGHEVTYITPFPKKNSNQNLRQINVADNIYAVNGQALNVQALMKHEVEMDQDLLFHMTVNVTKKTFENAAVQKLLNDPSEHFDVVIAEWMFNEIYSGVAAVFNCPLIWSFPYEPNFVGLSLIDEASNPAYSANIQFSDIPPFTFTQRVFALWFQIMHRVKYFLFYEKIETDVYENIFKTIVEKRGGHLQPYKEFKYSAAMILGNSHVSLGQAMRLPQNYVPIAGYHIDDVTPLPEDLKFIMDNAKNGVIYFSLGSNLKSKDLPTNIKKNLLKMFAELKQTVIWKFEEALPDLPTNVHILQWAPQTSILAHPSCILFITHGGLLSTTEAVHFGVPSIGIPVFFDQNFNVDQAVRRGITLKVMLSENCHIHLKNAIQDMLENPKYRQKMKELSFVYHHRPVPPGKLLVHWVEHVVRTNGAPHYRSVALLLPWYQKMYLDLIVTYITPFPYESSDPNLRLITTGDTVNAISGSSLNITALMLHEVEMDQDRHFQLAINITKNTLKNKSVQKLLNDPSESFDVIVAEWMFNDVYCGFSALFRCPYIWSFPYETNSISLGLLGEFSNPAYTANIETSDVPPFDFWQRVYSLWFRITSRVQHLLFSALFRCPYIWSFPYETNSISLGLLGEFSNPAYTANIETSDVPPFDFWQRVYSLWFRITSRVQHLFFYENIEKNLYEEIFSPILKKRGITTLPEYDILRYNASLILGNTDPSIGQALALPENYIPIAGYHIDEVKPLPQDLKDILDDAKHGVIYFSLGSNLKSKDFPEKILQDLLKLFGELQQTVIWKFEESLTNKPANVHILKWAPQQSILAHPNCVLFITHGGMLSVTEAVHFSVPFIGLPVFYDQNFNVAKSVQRGFAIKVSLSLNLAVELKDAVQEILNNNTYREAMKQTSITYHNRMIPSGDELVYWVEYVVRSNGAPHYRSAAFLLPWYQKMYLDFIAMVIACVCLFIYMIKTFCIKSKVQKIKSS

SEQ ID NO: 7226 - protein, 970 aa, Aethina tumida
MGKLIIFICAVLLCFTQDGQCARILASIFSPSFSHQLAFRPIWQELAKRGHDLTVITTDPVKDAPYKQIDTSHSYKMMEELGMSNAVSNRNQSARDAGKNYIDGLHKISDYQFGMPEVQALINNKKEHFDLLMIEVIFPGQMAFVDRFKAPFIGLVSLDAPPVIHRAVGNPTHPILYPDTVLPFNNDLNFKQRLISFAANIGFYVFSEYFFYPKEDLNVKKHFGEFPIRPLSEIQYDMDLLFINVNPFFHKLRPLGPNTIQIGGGTHLQKAKALPQDLQSFLDKSKNGVIYFSLGTNVKTSLISDELKATIIETLGELPYDVLWKYEDEMKGLPKNIKISKWIPQQDVFKHPKIKLFITQCGLQSIEEAISNHIPLLGMPFFGDQSKNAQVVLEKGLGLVVDKSILTKEEFKSKILETIKDPKFKNKVKEIAELMVDVQMTGLQKAVWWTEYAIRNKGAKHLRSSGVQDPFYIYFMLDVIGFVLLIVSIITYINYRITKFVYRVTLLTTDPVKDPKLKNLTEIDLSFTYDIFKRYNFPEFAANESKSFMQIGKELGEMLAEGFDAQLSSPEVQKLIHSEDVQFDLLIVEAQLPIMLGFGWKFQCPIIGVASLDASMNYHDTIGNPSHPIVNPDPNLPIGDPDNLSFKDRVTSFIYTNLYRYQVFNKYYPKENLRLRKFFGDDAPDLVEIQKNISMLMVSTNPIFHSVRPVNPNTIFIGNGLHLTPPKPLPKDLQKYLDNSKNGVIYFSLGSNVKGRLLNDTTKREILNAFADLPYNVLMKMDTELKDVPKNVRIEKWLPQQDILRHPNVKLFISQGGLQSLQESITNGIPLVGIPFFGDQISNVYRMVKKGYGVRLDKKEITKDNLKAAILEVMNNPKYREKAKEMGELLHDEPMTSLEKAVWWIEYVIRHKGAKHLRSPAVDLPVYQYYMLDVIGFLLLVTIIPIYLFVKILKFIVRKICCKKSKSKRD

SEQ ID NO: 7227 - protein, 696 aa, Papilio xuthus
MFPTPSISHQVVFRPLTQELAKRGHEVIVITPDPAFPKGQAPKNLTEIDVHDISYTKWKKIMSGIENIPRDPIEQLQVIINASFTIFEDQVKSESVQEILKYKEDYFDLILAEACIRPTLGLSYVFKAPVIQVSSFGAVMDNHDIIGSATHPILYPNLARERLYNLTMWEKISQLRNEFKSLTYTMNRGYDNQILKRLFGNNAPSIDKLYDNVAMLFLNFHPIWDNNRPVPPGVIYLGGLHQNPQKELPKDLKSYLDSSKNGVIYFSLGTNVKPSYLPPEKLEAIIKVFSRLPYDVLWKWDNDELPGRSSNIKISKWLPQSDLLRHPKIKLFITQGGMQSTDEAITAGVPLIGIPMLADQWYNVEKYVHHKIGLMVNINTLTEEKFENSIKTILNDNSYRENIVRLRSIMQDQPQSPLERAVWWTEHVLRHRGARHLRSPAANISWTQYLELELDLQKYLDSSVNGVIYVSFGTNVRPSLLPLEKIKILTEVFSELPYDVIFKWDKDELPGQTRNIRIVKWVPQADLLRHRNIKLFITQGGLQSTDEAITAGVPLLGIPIFADQWYNIEKYEKFKIGRGLNMDTLNKETLAAAITSLIEDESYRRNIERLRTIMNDQPMRPLDRAVWWIEHVLRFGGAAHLKSAGAHFTWSEYFELDILIILILLTFISLILSSLFCIAAWKFLSKYIWNVKLKTF

SEQ ID NO: 7228 - protein, 529 aa, Zootermopsis nevadensis
MVYTALLIRLRQMDHRTVLLLLLGAVCCTRSARILGIFPSPSISHQLPFQNIMKALASRGHQITVISPSPLKTPLPNYTDVDLSFSYEIIASFVDVTAMVEASPYEFCEQLIYALNIITEHQLSSPPLQAFIRSNDTKYDLVFLEALMYQSYHGLIHHVGSPPVIGILSVEFLLTMGDAMGTPTNPAIIPDVLLPHGDHMTFHERLQNTLFWLWTRYKKYTEWLPAQEELMRKFFGPNSPSIIDAERNISLLMVSSNWIFNYPIPLVPSVVTFHSLHVKTKTDPLPEDLQKFLDEAEDGVIYFSLGSNVQSDRIPEEKRIIFLEVFSELPQKILWKWESDILPRQPSNVKIGKWLPQQDVLAHPNIKMFISQCGLQSFQEAVYFGVPILGIPFFGDQKYNAKKIVTEELGVQLSLQDLTKETLSAAINAVLNDPRYQNSMKKMSAISKDEPQNSLDRAVWWTEYVIRHKGAKHLRSAAHDLAWYQYLLLDIVAVLILLLAITIFVSYIFLKNIYRYLTKKYYEVKSKHD

SEQ ID NO: 7229 - protein, 530 aa, Papio anubis
MTRTGWSSPLPLCVCLLLACGFAEAGKLLVVPMDGSHWFSMRSVVEKLILRGHEVVVVIPKVSWQLGRSLNCTVKTYSTSYTLEVLDREFKAFAQAQWKAQVQSIFSLLMSSYNDIFDLFFSNCRSLFKDKKLVEYLKESSFDAVFLDPFDTCGLIVAKYLSLPSVVFARGIFCHYLEEGAQCPAPLSYVPRILLGFSDAMTFKERVRNHIMHLEERLLCHRFFKSALEIASEILQTPVTVYDLHRQISIWLLRTDFVLDYPKPVMPNMVFIGGINCHQGKPLPMEFEAYINASGEHGIVVFSLGSMVAEIPEKKAMAIADALGKIPQTVLWRYTGTPPSNLANNTILVKWLPQNDLLGHPMTRAFITHAGSHGIYEGICNGVPMVMMPLFGDQMDNAKRMETKGAGVTLNVLEMTSEDLENALKAVINDKSYKENIMHLSSLHKDRPVEPLDLAVFWVEFVMRHKGAPHLRPAAHDLTWYQYHSLDVIGFLLAIVLTVAFIAFKCCAYGYRKCFGKKGRVKKAHKSKTH

SEQ ID NO: 7230 - protein, 521 aa, Bombus terrestris
MKLLSVVLICTLLSISHGYRILGVFPFNGKSHFMMFEQLMKILAKRGHQVDVISTFPLTKPYPNYNDLIVLPAGRQFMNNMTYNEIKTLFADSPTHAVATLAGNDICEFLNNSQMQQLIRNPPNDPPYDAVIIEVFGAQCFAIFGDILKVPVIGASSSVLYPWIYECIANPENLAFAPSNLVAYPQNMNFWQRMYNFVNTVYTKWRFQAKTTKQTDILRKYVSPDAPDIREVEKKISIILGNSHMSINGIKHTTPAYIEVGGLHVRDEGVELPLSLEKWMNESTHGFVYFSFGSMVKIESFPMNLLNIFYNSMSKISPIRVLMKIAKPDELPPGLPKNVHVLPWVPQVKVLQHKNVKAFITHGGLMGTQEAIQYGVPLIGIPLFADQFININTYVRLNIAVGLEIDTLTEEKMDHALNSILNDPKYRDTAKKLSRKFMDRPLSAADTAIYWVEYIIRHGANALRSPAMDLTWWQVELLDVGAFILIAIIAALYIIMTVIQFMFNLTFSNSNSNDLRKKKIS

SEQ ID NO: 7231 - protein, 484 aa, Tetraodon nigroviridis
MKTCSVFLVLLCVSTSAFGGHVLVFPGEYSHWLNIRTIVDELVRRNHSVTLLVADASPSVNYNNSLDAAKFNFLVYKVPFSRSEFHQLTENLVHFSMYEYHAASYLERFRKMHAWTQAFLGYGLKQCESMLRNKQLMATLRDAAFHAVLLDPMAMCGDLVADVLGLPLIISLRFSFGAVLERHCGHVPAPPSYVPPPPLPYSDRMSFTERLVSVLTYAFTSAVTKLVWSWTLDGFYSEIKGSPSTMCETLGRADIWLMRNFWDMETPRPTLPNFKHVGGLHCKPAAPLPEARDLEAFVQSSGEAGVVVVTFGSMVTNLTSERAEVFAAAFGRLPQKVVWRYRGEPPKALSANTKLLKWIPQNDLLGHPKTRAFVTHGGANGLYEALFHAVPLVGIPLFGDQPDNLARLVRLGIAVSLDFNHLTSDQLTEALDTVITQGSYRASMRRLSRIHRDQPATPLDTAVYWVEFVMRHGGANTCARRPTT

SEQ ID NO: 7232 - protein, 239 aa, Camelus ferus
ELEELVQSSGEDGVVVFSLGSMVKNITEEKANMIASALAQIPQKVLWRYTGKKPDTLGANTQLYEWIPQNDLLGHPQTRAFITHSGTNGVYEAIYHGVPMVGIPMFGDQHDNIARVKVKGAAVEVDLHTMTSSDLLNALKEVINNPFYKENAMKLSRIHHDQPVKPLDRAVFWIEFVMRHKGAKHLRPALHNLSWYQHHSLDVIGFLLACVATIIFLVTKCCLFCCSRFGKTTKKKKRE

SEQ ID NO: 7233 - protein, 532 aa, Ovis aries
MAPAMLMGFFPVCVCLLLTPGFAEAGKLLVVPMDGSHWFTMRSVVEKLSQRGHEIVLVIPEVSWHLSNSSNITIKTYHTAYTLEDLNVAFRKFSDFQWKVRPQSLLPMLISSENTIFDYFFSRCKSLFEDKKLVKYLEESSFDAVFLDPFDMCGLIIAKYLSLPSVIFTRGVFCHYFEEGTQSPMALSYVPRAFLAFSDAMTFEQRVWNLIRHIEERLFCPYFYKNVEEIASQILQTPVTTSELFSQTSIWLLRNDFVLDYPRPVMPNVVFISGINCQKLNQKPLSEEFEAYVNASGEHGIVIFSLGSMVSEIPEQKAMEIADALGKIPQTVLWRYTGTPPPNLAKNTKLVKWLPQNDLLGHPKTRAFITHSGSHGVYEGICNGVPMVMMPLFGDQMDNAKRMETRGAGITLNVLEMSSGDLENALKAVINEKSYKENIMRLSRLHKDRPIEPLDLAVFWVEFVMRHKGASHLRPAAHDLTWYQYHSLDVIGFLLAVTLTVIFITFKACAFTFRKCFGKKERVKKSHKSKTH

SEQ ID NO: 7234 - protein, 510 aa, Athalia rosae
MGHEGFGAKILGLFPYPGRSHLSITSSLMHGLARKGHNVTAFVPNATGLGTPNYKEINYKAVPVTGSTHMLDYLSTSFFVKHFKLYEIGITTTEKALNTSEARDLIRSEEKYDVIIMEEFVNEAFYVFAHKFKCPVILIHTFGTSTVINGLFGNSAPRSYVPLEYLNLGDKMTLSERIQNSLQDMLSVVTRELYYMPRQQALAVKYLGDSGVEIPDLQEIAARQTRFILINNHPVFYTPRPYMENMKNVGGLHLKPAKPLPLDLQQYLDSSQNGVILFSLGSSIQSVQMPERFTEALKKAFQRSPFDVLWKWENDTMARKSSNVRIEKWLPQNDILAHPNVKMFITHGGISSMMEAVYHGVPVIGIPLFGDQMRNILLAVSKGYAESLDFFTTTDDQVYDTIMKVATDSKYKENVKKVSACWRDDLNHPLDRAIYWVEYVVKHDGVKHLKAAVTEQTFVQYLLLDVAFVILTTLVLSFFAIRQMFRLLWRHTYISIYKISSFEDNLKKLD

SEQ ID NO: 7235 - protein, 524 aa, Toxocara canis
MKLFLTFLAFILPVECLKILIYQVAVGRSHMSFSGALTDILADAGHEVHLLISEWNPSAKDDCTKRATSIRRIRMPPNGTTISHLAHLADPFKMTVWKYFSSMEQFKIMKDVPSLFCKMIINDDELMKWLREQHFDAALTSMYDLCPFGLFHVTGIKPVIGYVATPIISNVIAALKIDSPASYTPDLMLATWSGDEMNYGERAKNLFVQAFTSHILLPFLRSYQQAVFIDKFGNDFPSLMALASKTSFVFINSNELFELPRLLSHKIVYIGGIALRPHKKVPEEYSKLLSERDGSVLFSLGSLAKTSLMPLEMKNAFIEAFAKFPNYTFIWKVDADAINDPILKRYPNIKAVSWMPQYDLLRDGRLNAFITHGGLNSINEAIVAGVPMIVIPLFADQNLNAATAVKRGLAYPLDKWNITTEHVTSALKALLLDRSYADNAKLLSRMLAKKPRKPREDFLHYVEFASEFKSVGDNLQLHAVYLNFIQLHCLDIIVPAVIVMILFVYMIFVMTRRVLRRVVKLKKE

SEQ ID NO: 7236 - protein, 519 aa, Trichoplusia ni
MGVSVHYLVFLLFVNTNEAARILAVFPIPSVSHQVVFRPVTHELARRGHDVTVMTTDPAFPNGGAPANLTEIDVHELSYDIWKKNYMIHSKGNEKDTMSQLRISFELFIMLFDEQLRHKDMQKLINDKSQKFDLLIIEGIFRPARALAHVFKAPMILLSSLSPLFDNIEIIGAPGHPLLYPEATRQRLNNLTWLGKLSELYNHYKIQNIYHNSLVYENEMLRKHFGPDFPCVTEFNKDVDMLMVNVNPVFAGIQPVPPSMVFMGGLHIKPDSELPADLKSYLDNSKHGVIYISFGTNVDPTLLPPDQIQVLVKTLSKLPYDVLWKWNGDGLPGRSKNIRISKWFPQSDLLKHPKVKVFVTQGGLQSTDEAITAGVPLIGVPMLGDQWFNVERYEYHKIGIRMDLSSATEELFKDALLKIINDDSYRKNIVKLHTLMVDQPQKPLERAIWNIEYVLRHGGAKHLRSPAANISWAEYLELELVLTLLLVLVAIITVLVLIIRKLLKCFFEKPVPKVKSKRS

SEQ ID NO: 7237 - protein, 533 aa, Pteropus vampyrus
MTTGLQLPLPMLTGLLLFLCVGPWAEGGKVLVVPMEGSHWLSMQKAVKELHARGHQIVVLAPEVTVHIKREDFFTLKTYAVPYTQDEYEQQLLGQVDLIFEKVHFLKMYLNVMAISKNISLFFEKTCAALLYNKDLIGHLNASAFDVVLTDPVYPCGAVLAQYLSVPAVFFLNFLPCDLDYEATQCPNPSSYIPTLFTRNSDHMTFLQRVKNMIYPVSMKYICDITFSPYSRLASELLQRQVSLVDIFSYASMWLFRGDFVLNYPRPIMPNMVFIGGINCADRKPLLQEFEAYINASGEHGIVVFSLGSMVSEIPEKKAMQIADALGTIPQTVLWRYTGPRPSNLAKNTILVKWLPQNDLLGHPMTRAFITHSGSHGIYEGICNGVPMVMMPLFADQMDNAKRMETRGAGVTLNVLEMTSEDLANALKTVISDKSYKENIMRLSSLHKDRPVEPLDLAVFWVEFVMRHKGAKHLRPAAHDLNWYQYHSLDVIGFLLAVVLGVVFIVCKCCVFGYRKCFGKKERAKKSHKSKVQ

SEQ ID NO: 7238 - protein, 794 aa, Oesophagostomum dentatum
MVMVSALGMLSRMYDVIGIPEVPSFMPLAITPYSDEMTFMERLRNFKISVQLRYFIQQWEQEFWKLFNSKYPGFPSIQHIYLEKTALIMINVNEFAETPRPTVNMVRYVGGSTLHDSQPLSEELDRLLNEREANVLFSLGSLAQSKDMPRRLKDDIVETFASFPNVTFIWKYEGDDILHEAHPNIYTTKWVPQTDLLDDRRLSLFITHGGMNSMLEAMFHGVPMVVIPLFGDQQLNSRNIQRRGIGTLVERNKLNKKTLTAAIKKTLNNKKISREATFVASLLAGRPQQYRDDISKWAKIIIEHGLLSAFTSMYVLIVICALVAAISVKASNILVWNPTIAHSHINFMGRVADALSADGHNVVCIFLGVLSVCHRNCRHSCQVCHFSLMRGIILPKYLLQTIFSPSIEADKTYFGNQLPAQTVRYVPRKAGDGYLKEFMKTSIWEAPPCSGVCFDWHAFDMMNDLTLRYCKDLLDDEIMLDRLKRSKFELAFIEVLDVCAPGIIEFFLCITDFLLQILDIKNIILPSGCHMLPQLYEVAGIVGLPSFVPGVVTPYSDDMTFIERFRNFITSLQFKLFIERWNHKFWKLFNAKYPGFPTIKEIYLEKTSLIMVNVNEFAESPRPRTNMIRYIGGAAQPEPKPLSKLFLCTTDFLLQILDIKNIILPSGCHMLPQLYEVAGIVGLPSFVPGVITPYSDDMTFIERFRNFITSLQFKLFIDRWNHKFWKLFNAKYPGFPTTREIYFEKTSLIMVNANEFAESPRPRTNMIRYIGGAAQPDPKPLSKVKRVQGTLTKA

SEQ ID NO: 7239 - protein, 208 aa, Aethina tumida
MDDINRKYFGDDIPDMNSLIDLTDMIFIITDPIFHNMRAVNPNTLNIGGGLHIKPPKPLPKDLKQYLDEAEEGVIYFSLGSNVKGNFLDEQSKKAIISVFSQLPYKVLMKIELENYNIPQNIKIGKWLPQQDILRHPNIKLFVTHGGLQSVQEAVTNGVPMVGIPFFGDQYNNIFKGVKKGFVVKVDKENITEESFKEALLEVLNNPK

SEQ ID NO: 7240 - protein, 277 aa, Oesophagostomum dentatum
MVNSNELYELPRPTLAKVVNIGGLGVQHKDAKPLEGEFKKVAEGGKGMIVMSFGSVAHAELMPEHWKTALLTAFAQFSDYEFLMKYGSDDLKDRLPANVHAYRWLPQADLLLHPSTKVFISHGGYNSLQESINSGVPLITIPLFGDQFKNSRIAVKHGFAVNVNKATISEFSIAEALKEVINNEKYAQNAKRLSQMVRKKPVSPGQLLVRWTEFLAEFQTLDNLTPAGNDLYLFQYFSLDVISCSLVVSFVVLFAVYKILCVTVQRIFSNSTKVKGE

SEQ ID NO: 7241 - protein, 789 aa, Aethina tumida
MGNPRHPAFVPEIFLGFGERMTFLERIQNTAFNVWYRYYHHWINVPDWDKIARKFFGNEMPYLGDLEKEIPLVLVNTNPVLDYVKPSVPGVIEIGQMHIKPKKPLPNDLKDYLDNSKKGVVYFSLGSNVLSSNTAPEFLNAIKEAMSELPYDFMWKWETDDLPNKPQNVLIRKWFPQQDILAFVTQGGLQSMEEAITNGVPMVVIPYFGDQPYNAKRMVHMEIAKELNYKMLTKENFKQAVTEVVENDKYKRNVVKYSKLLVDQPMTGLEKAYYVFFFLCFSLVNSANILGYFPTCSISHQVIFQPIWKELSLRGHKVTVITPNPLNDPSLTNLTEIDISYMYGEMSVMINKILALGEMNIYSRLINQFEILRTLEDDTISSKGIQELLKDDNQQFDLVMVEWFHSIGLGFGYKYNAPVIGVSSFFGIPNIHEVMGNPRHPAFMPDIFLGFGERMSFLERIQNTAFNVWYRYFHHWVNVPEWDKIARKHFGNDIPYIGDLEKNISLVIINSNPVLDYVKPSVPGVIEINQMHIKPKKSLPKDLKDYLDKSKNGVIYFSLGTNVLSSKTDPEFLNAIKEAISELPYNFMWKWETDDLPNKPKNVLIRKWFPQQDLLDHPNIKAFVTQGGLQSMEEAITNAVPMVVIPYFGDQPYNAKRMVHMEIAKELNYKTLTKEDFKQAVTEVIENDKYKRNVVKYSKLLVDQPMTGLEKAVWWTEFTLRHKGDFNLRGYGADVPYYQYFLLDIIALALIIVLVTILSMKRLVKSILSILLFITSREISSYYAIMFYT

SEQ ID NO: 7242 - protein, 517 aa, Cephus cinctus
MKSLKIFTVITVLFGISHGLKILGVFPLSSKSHWMMYRSIVEELMHKGHEIDVITPFPLRHSAPNYKEIIIEVLDLQMENVTLDIIQHSNPFTDTAFMSIMAGNDLCELLRREPLSSFIKNTPRDKYDIFLTEIFGANCYLGFGAHFDVPLVAVTSSVILPWENDYVANPESTSYVPNYMLPYTDRMNFYERFVNTVMSIIIKYEFAYFTKSQDVVLKEVFGPDSPGVRELESKIDLLLVNSHYSINTLRPLVPAVVEVGGLHVHENVADKMTPELEKWMNDSTNGVVYFSLGSMVKPESFPPTIINSLYKSFSQLAPIRVLWKANKTELPSGLPDNVRTMDWIPQADVLRHKNVKVFISHGGLMGTQEAVYAGVPIVGIPLFADQALNINNYVTKKIAVRVDFNDISVKTLSEALNTVINDPTYWVNAKYISKRFRDRQASPLDTAVWWIEYVARYGKGSLRAAAVDMPWWQLALIDVYAAIILILGASLYLLKIIVKLILSAISNHFSAKQKKIQ

SEQ ID NO: 7243 - protein, 454 aa, Papilio machaon
MGIKMRTAVLLVMVLVINSTIAHKILCITPAPTRSHAILGRGIVNTLLEAGHQVTWVTAFPDKSINKNLRQIDLPKSREIIKDIDATNQGRMSMSMLREFARNISIAALETPELRNVLINEKFDAVVTEWFFSDLEAGFSRQDSTAVEAHYDKQFSSIAKARGVSLPPLSISRHNISIMLVNSHTSFAPAQPLPPNVIEIAGYHIEETTPPLPKDLQDLLDSSRNGVVYFSMGSVLKSAALPESTKRELLRVLGSLPYTVLWKFEDQLEGLPKNVHIRSWMPQASILAHPNVKVFITHGGLLSTLEALRYGVPLLAIPVFGDQPGNAIRAMRSGYARKVTFSPDMAPELERELKHMLADDTYYKKAKELSKLFNNRPVTQRKLIRHYIELAIDTKGAYHLRSKSQLYKWYELWMLDQLAVVVTALLFIYLLLKKIVSVFTKKNVKEVKKSKKNK

SEQ ID NO: 7244 - protein, 495 aa, Trichogramma pretiosum
MKSHFAMNEQLMKGLAAKGHQVDVYSHFPLDKPIENYREFTIVDPLVANFTNNLNRDLLNSWMSSNFIPIREIMNTLGESNCQQLGRKEFQKLIETYRNKNSTYDVIVMQPYVAACFLAFGRYLNLPIVTVETLRMTDWTYSSFGSPHYPAIMSSAYAGFSAPMSFWERVKNFLITNYMHYGFYWLVKNQDEYVKQYFGDDYPSTGELLKDVDLMLINYNQMLHGVRPYTPAIVPVGGLHIDTSERKLSEKVQKFLDDSENGFVYFSFGSMVRIETFPEHILKIFYDAFRKIAPIRVLWKIAKPEELPSGLPDNVLTDTWLPQMEVLKHKNIRAFITHGGLMGTMEAIYNAVPMIGVPLFVDQYANMDLYQKRKIAVSLDYYKINNESFIQALEEILENPNYKKEIAKLSQSFRDTPMSPLDTAAYWIEFIARNGKKSLRSPLVDMPWWQTSILDVYMFVAVVIFLIVSLVAIIVQKFKRLLLRCMNKSKKIKVN

SEQ ID NO: 7245 - protein, 525 aa, Solenopsis invicta
MKVLLSVLLTILACDQAANGLRILGLFPLHGKSHWIMQEALMKELAKRGHQVDVVTHFPLKKPIPNYKDISLEGSLPSVVNNMSAVEVLRFQTPNVAYLVQMAGTQLCELLNHPKLQELIKNPPQDPPYDLIVTESFAAPCFLAFGRHLKVPIIATVASVFHDWLNEVSGNPANPAFVPSFFSTHSSSMNFKERLTNAFLSNYLSWQFHYHSNKQVAIVKEHFGLDLSCIKDLYNDIAVYLVNSHHSLNGIRPMTTSVIEIGGMHLKDDNPPSPEVQKWLDESKDGCIYFTFGSMVRIETFPKETVQQFYAAFEKIAPVRVLMKVAKKEDLLPGLPKNVMTQSWFPQISVLKHKNIRAFITHGGVFSTQEAIYTAVPMIGVPLFGDQAINIQNYVNKKVAVSLDIRNITEAKVTSALNTILKDPSYSENIRKLSNKFLDRPLSAMDTSVYWIEYIGKYGNVLRSPALDLYWWQRELLDVYAFIFGIMAVGLYVVLFILCKIKKCLCGSRTCAKKDSAAMKSKKNK

SEQ ID NO: 7246 - protein, 533 aa, Mesocricetus auratus
MAMGLQVSLQGLSGLVLLLCSLPWAESGKVLVIPMEGSHWLSMKTIVRELHARGHETVVLAPDVSVYIKEDDFFTLKSYAVPYTKEEYEHNLLSLLQMFFENEYSVTMFLSNMELMKNISAFYVRSCTSLLHNTGLIQHLNSSSYEVVLTDPEYPCGALLAKYLNIPAVFLLRFIPSDVEFEAAQCPSPPSYVPRLLTRNSDHMSFLERVKNILYNLPFKIIFHFSYIPYESLALDLLQRQVSFMEILSHASIWLLRFDFVFEYPRPIMPNMFFVGGMNCAIRKPLSQEFEAYVNASGEHGIVIFSLGSMVSEIPEKKAMEIAEALGRIPQTVLWRYTGPKPSNLAKNTILVKWLPQNDLLGHPKTRAFITHSGSHGIYEGICNGVPMVMMPLFGDQMDNAKRMETRGAGVSLNVLEMTVDDLENALKKVINDKSYKENIMRLSRLHKDRPIEPLDLAVFWVEYVMRHKGAPHLRPAAHDLTWYQYHSLDVIGFLLAIVLTVVFIVFKCCAYGFRKCFGKKGRVKKSHKSKTH

SEQ ID NO: 7247 - protein, 1553 aa, Caenorhabditis remanei
  MOD_RES (819)..(819): Any amino acid
MNVKFLISVSLLVLFNSTDASKILIFNPIFGFSHVKFISKLADIIAEHGHNVTLFQPYHNAMKNVEGLVKNKNIEILNYYPTHYDELLKKETQTFSIFWDSQLIGNPVLGAFMLPFVLGGEFKKTSMDLAHLLDVPCIPMMSTVRYPIFNGLFGQPSFLGTVPQQGSLGAPEAGFLDRLNDIYRFIFTGIAQERLNKYQNDFIQEAIGRPVPNWKDLVSQSPIFITNSNPYLDYAVPTTAAIVHVGGITMNLDKMKNTGKLPEEYENILKERESTILLSFGSVIRSYEMPENFKAGIIQMFESLPDVTFIWKYEKDDVEFQKRLPKNVHLRKWVPQPALLADERVKVFVTHGGLGSIMEVAYSGKPAIVVPIFGDQSHNAMMLARHGGAVAYDKFDLQYGQKLAGVITELISNPKYKENAKMLLEVLVNQPIDPKINFLNHLDFAIKFPALRSQVPAIQHVGWIAHYYLDALTLFQPFHIPLKNMDGLVKNKNIEILNYYPDHYDELLNTESPTFPMFWDSHLMNNPVLQSVMMPRMIVKELQRTDEQILLDTKLHETLKNKKFDVAIAETFGISGFYLAHFLDLPCIPVMSAVRFQVFNELTGYIPQIGSKRASEAGFLDRLNDVYMKFFDKITVEKMGQLQNDNFENALGRPLPNWKDLISESPVYITNSNPYLDFAVPTTATIVHAGGITIDLKKLRNVGPLPEEYEQILQERDSTILISFGSVIRSYQMPDNFKAGIIQMFESLPDVTFIWKYEKDDVEFQKRLPKNVHLKKWVPQPALLADKRLKVFVTHGGLGSTMEVAYTGKPALMVPIFGXQPQNAYMLERHGGAIAYDKFDLQDGDKLTKIMKDMVTNPKYNENAHALLEVLSNQPIDPKMNLMKHLDFAIKFPKLRSQVPAISHVGIIAHYYLDLLSFLSFSLLGFSSGKNILMFNPMFGFSHVKFVSFMADVIADHGHNVTLFQPFHNAMKNTEGLVKNKNIEIINYYPNHYDELVNLETQTFPMFWDSHLMNNPILQAFMMPRALAGEFERTSVHIAHLLEIPAIPIMSSVRFPCFNDLFGQPSGLGYYPHIGSKMAPEAGFLDRLNDIYRNFFMYVMMHRMANIQNDYVENAIGRPVPNWKDLVSRSPIFITNSNPYLDYAVPTTAAIVHAGGITMDLKKMKHVGKLPEEYVPILDERESTVLISFGSVIRSFQMPENFKAGIIQMFESLPDVTFIWKYEKDDVEFQKRLPKNVHLKKWVPQPALLADERVKVFVTHGGLGSTMEVAYSGKPALMVPIFGDQPLNAYMLERHGGAIAYDKFDLADGYKLTKTLKDMVSNPKYFKNAKELLEVLSNQPIDPKLNLIKHLEFAMQFPNLRAQVPAINHVGIIAHYYLDAIAFLVFVGGLTVYIGFLILLGIEVSGKNILIYNSVFGYSHVKFISLMANIIADHGHNVTLFQPYHILHNTEGLVKNKNIEIIDYFPDHYDELVNAEAETFPMFWDDPLVNHPILETIIAPKLISGAIERTATQLFKDQEVLNQLKSKKFDVVIAETFELTGTLPIFLMFHVFP

SEQ ID NO: 7248 - protein, 490 aa, Photinus pyralis
MFACVAVISFAVLLGVGDSAKILGVVPTPSISHQVVFQPFFRELSLRGHEVTALTTDPMRDPKLSNLTEIDLHFSYRIWNEHIMKNALKFKTNPIGATIDFYKSTIDIQDEQLRHPSVQALIRGEEKFDLIIIESIMPALFGFVHKFKCPYIMMFSQEAPSDYYKLMGNPTHPILYPDAIFQYDQQLPFPQRLLAVLTMPLFPLFARYIFSMHDHLVQNHFGDDYPSIVELMSKPDMLFVHTDQIFHKELKNKLDNAEHGFVYFSLGSNVKSKDLPPELLDTILSTFAELPYTILWKFEGAHLDGLSDNVITSPWLPQQDVLRHPNIKLFITQGGLQSLEEAMYSGVPILGVPFYGDQTGNVKRMEIGGTGLIVDYATVTKDEFKAKILEVAQNTRFRNKAKELAALAQDQPMTGLERAVWWTEYVIRHKGASHLRSPLLDVPWYQYLLLDVLAVIASVMVIVGLLVFYIVRWFIGLLTCRRKKNEKKIQ

SEQ ID NO: 7249 - protein, 520 aa, Spodoptera litura
MLSFVYVITFSAFLVNQSETARILAMFPVASISHQVVFRPLTQELVRRGHEVTVITPDPAFPKAEAPANLTEIDVHDISYELWNSIFLDTRKDNKGDVIFAIKKIYEAITAIVDAQFQDERVRNIIDDKSKQFDLILVEAMVRPTLVLSNIFKAPLIQISSFGGVIDTYENMGASIHPFLYPSITRQRLHNLTLLEKIKELYSYYQINRIYKNNEVNENKVLRKNFGDQVPTIAELKNNVDMLFININPIFEGIRPVPPSVIYMGGLHQKPNKDLPAELQSYLDSSKTGVIYISFGSNVDPTLLPADRIEVLVKTLSQMPYDVLWKWNGDVLPGRTDNIRIAKWLPQQDLLRHPKIKLFITQAGLQSTDEAISGGVPMIAFPMFADQPYNAEKYEFFKIGIKLNLDKLTVEQFTGVIKTVIEDKSYKKNVEKLRSVMYDQPQSPLERAVWWTEHVLRHGGARHLRGPAANMSWVEYLELELVFTVLLGLFVILLVLVYIIRVIVKAIFSSIVSTPKVKKN

SEQ ID NO: 7250 - protein, 533 aa, Ovis aries
MALGLQLRRQVLAGLLLCLCVGRWAEAGKVLVVPMEGSHWLSMREAVRELHARGHQAVVVAPEVNMHIKAEDFFTMKTYGIPYTQEKLDSLMKTHVQLLFEKVHWVTLFLKSMASLKNASLLFERSCEGLLYNKDLIRNLNASSFDVVLTDPVHPCGAVLAKYLSIPAVFFLRQIPCDLDVEGTACPNPFSYVPRLLTMNPDRMTFFQRVKNMLYPLALKYICQVVFTPYARMASELLQREVSLGEILASGSVWLFRGDFVMDYPRPIMPNMVFIGGINCANRKPLSQEFEAYVNASGEHGIVIFSLGSMVSEIPEQKAMEIADALGKIPQTVLWRYTGTPPPNLAKNTKLVKWLPQNDLLGHPKTRAFITHSGSHGVYEGICNGVPMVMMPLFGDQMDNAKRMETRGAGITLNVLEMSSGDLENALKAVINEKSYKENIMRLSRLHKDRPIEPLDLAVFWVEFVMRHKGASHLRPAAHDLTWYQYHSLDVIGFLLAVTLTVIFITFKACAFTFRKCFGKKERVKKSHKSKTH

SEQ ID NO: 7251 - protein, 943 aa, Caenorhabditis briggsae
MDIHMIIITFFINLLFLHIVESARVLLTVMDQGRSHATSINTFMHRLQKDNHTTALEFAWFHPDIDFGMDERFIDMKGFDNPFASPDFDKIAFEEDYSFIHQAVAYGFGSKTCDNILKHKKERFNEILSEDWDLYLSDSLFAVCGYGMAEISGKPHVMMHSTDLESAQGSFKAFSRNYATFVPSNLPFTMLDFSVTKYFHRIWAAYDWFGSFIFTAFVGNFAQKWALRSIIPFPYFSFSEYNRRSSYSFTDMPDSLFPPASRTNDFFSFGAYCKPSSTPLPSDFLSFIDDPKSKGTILIAFGTFIDWRRAPKHYYDTFSTIVNQLTDYRVIWSMKGERPPGLRDHVKTSSWVPQNQILHHNKTVLFLSHGGLKSTKEVICSATPTIFVPMFGEQTRNSWLIKEKGFGRIMNKFNINVKELGTHVREVLEHPTYQDKANKFLTYYMDQPIPTLDEGAFRFSKLLKYGGRMPAFFYPRALDLSHITVLNLDLAILVFFFDGTKRQNLEKLVGWLRLQFRNHITASVETALQMVLRSELLFQLNRYLGGLLRFRNGNGGRSMYVDCLVDTPDNEEARLEINEGVRREIPRIDRPIAENRGRMTTEYYEDISPPTRQPVPEPVDSFDQKMARNLNSAVTYVGPARRFGPSLVPREESATDYFVADVPSTSSSFPDWPALSNPQPHCSRQPDPAASNSSHTLPPRTQCAERVQTPLTESDVIQEYDQFSEDDEPTLGDDLESLTPIRENIPPLQNVPMESQRAPRNADIRDNNANDSEKTIPHNQSDSESYEIFSEFQSISALILPKELMEGVYKSLAKNDVPEKSHDQQAEFIMGKLFPKRSPPVNASMYRTGDNKVLGFQNSDTHRIWLTPIENQVIFLNGKLVACEPRKLGICEICASYKFSNHETLRCDSCKRVFHAKCFAVRAQRKGKCICRARLCPEKNPYV

SEQ ID NO: 7252 - protein, 519 aa, Trichoplusia ni
MRILCLLTCFILTVHTNEAARILAVIPTPSISHQVVFRPLIQELAKRGHDVTIITTDPAFPKGGAPANLTEIDVHDISYQLYEQILTDMPRGKKNDIQSQTAAFTSFIAKAVDIQLSDEGVRKLIEDKNQKFDLLILEAWVRPALVFTYIYDAPVILMSSFGALFDNDAMVGTPTHPILYPTVFRQRLNNLTMWEKITEMYSHYRIQNAFYELRHFEDKILQKHFGPNIPSVMELSNNVDMLFLNLYPVFEGIRPVPPNVIYTGGLHQNPVKDLPQDLKSYLDSSKNGVIYISFGTNVDPTLLPADRIQVLVKAFSELPYDVLWKWNGDELPGRTENIRISKWLPQSDLLRHPKIKLFVTQGGLQSTDEAISAGVPLIGVPMLGDQWFNVERYVYHKIGVRLDLDDITVENFKSNIHKVIGDESYRQNTIKLRGFMRDEIQTPLERAVWWTEYVLRHGGAKHLRSPAANISWAEYLELELVLTLLAGLFVIVTAFVFILLTLYKHFLKKFLGTIKVKRA

SEQ ID NO: 7253 - protein, 531 aa, Galeopterus variegatus
MACLLGAFQRSSAGVFFLALWGMVVGDKLLVVPLDGSHWLSMKHIVEVLSVRGHEIVVLVPEVNLLLRESKYYTREIYPVPYFQEELKNRFSSFENSLFAERSFLTAAQKEYRNSMIVLELSFINCQSLLKDRATLNFLKESKFDALFTDPALPCGVILAEYLGLPSVYLFRGFPCSLEYAFTRTPNPVSYVPRCYTEFTDHMTFPQRVANFLVSLLENYLFHCLYSKYGELALDVLEREVHLPTLYQNGSVWLLRYDFVFEYPRPVMPNMVFIGGTNCRKSRDLSQEFEAYVNASGEHGIVVFSLGSMVSEIPEKKAMAIADALGKIPQTVLWRYTGPRPSNLANNTILVKWLPQNDLLGHPKTRAFITHSGSHGIYEGICNGVPMVMMPLFGDQMDNAKRMETKGAGVTLNVLEMTSEDLENALKAVINDKSYKENIMHLSSLHKDRPIEPLDLAVFWIEFVMRHKGAPHLRPAAHDLTWYQYHSLDVIGFLLAIVLTVAFIAFKCCAYGCRKCFGKKGRVKARKSKAQ

SEQ ID NO: 7254 - protein, 531 aa, Drosophila willistoni
MQPLRSKTRCISIFFLLSCLLSYATAFNYLVVLHTGARSHYNVGSALAKGLAAAGHQVTIVSPFELKKPNPNITEVSVPSILEAMKGNTDNLLETSEKPILNQILGFYEMGINITKALLEDPTIKEFKKSKQTFDAVICEVFLNEALFGFAEHFNAPLIGLGTFGAISWNTDLVGSPSPPSYIPHALLKFSDHMSLVERVGNLAFLTYEEIFMNLYYLPKQEEVYRKYFPNNKQDFYDMRKNTALVLLNQHVSLSFPRPYSPNMIEVGGMHINRKRQPLPKDIEDFINGAEHGVIYFSMGSNLKSKNLPLEKRQALIETFGKLKQRVLWKFEDTNMPGKPANVFISDWFPQDDILAHKNVIAFITHGGLLSTTESIYHGKPFVGIPIFGDQFLNMARAESNGYGVTVNFKELTTEKLTNAIERIISTPEATQKVLDMSARYKDQKELPLERAVYWVEHVSRHKGAKYLRSASQDLNFVQYHNLDAILILYGGIIFILYCLMLLIRLAFRGLQEFFINRNSKASQDKSKKRN

SEQ ID NO: 7255 - protein, 528 aa, Papilio polytes
MLNHIILLILATLASRDVGDCARILGLFPHTGKSHFMVFEPLLRALAERGHHVTTVSFFPLKNPPSNYTDVVIEGAMQDGLSSLDMSMFETSTPLMKVPLLNTILKNIFEMEMSAPLALATCKSIIRQSSVIEAFKQKYDVLIVENFNSDCMLGLAHVFGIKAPIVGISSCAIMPWTYARFGLPDNASYIPLVTTAYSSYMTFIQRLDSFISKLYVDGMYHMIQNKERSVIEKHFGVKIPDLEEIGKKQTSVLLVNTFPTLNGVRPTLPSIIEVGGMHLDHSRKVLPSYIEKFLNESEHGVVLLSFGSLIKTSTIPKYKEDIIVNALSKLKQRIIWKFEGSAEEGTLTGNILRVKWLPQYELLQHKKIIAFISHGGLLGMTEAISAGKPMVVVPFFGDQPANAEAAAVAGLATTVPYIELTKERLTKALDFVMSDETKSNAKRVSSIWRDRQADPLETAVYWTERVIRWGHHAPLHSPARDMPLYQVALLDVIATLAVAIFILLAISWYILSKVFRLLFARESKLKMH

SEQ ID NO: 7256 - protein, 446 aa, Haplochromis burtoni
MMQVSTSLPLLLLSLTLLLLHPVSPVHGGHVLAFPGEFSHWLNMRTIIEELVKRNHSVTILVPDASPSVNYNNSRDTAKFNFLVFKVSYSRQEYLDLMQELMRFSMYEAHLSSPLQKFLKTASWILHFLDFGRQQCDGMLRNKQLMATLRHTSFDVILQDSMAMCGDLVADLLSVPLIISMRFSFGSVFERHCGHAPAPPSYVPLAPLSYNDHMTLSERLINMVIYLGSSAVSELTWKLTLDQYYREIKGTPSSVCETMGKADVWLIRTFWDIETPRPTPPNFKYVGGLHCKPANQLPEDLEAFVQSSGDAGIIVASFGSMVTNLTMQHANIIATGFGQIPQKVIWRYRGEAPTALAPNTKISDWIPQNDLLGHPKTKAFVTHGGTNSLYEAVFHGVPLVGMPLFGDQPDNLARMSRLSTAIVLDFNHLTAEELAEALHVVTNQPW

SEQ ID NO: 7257 - protein, 530 aa, Cavia porcellus
MSMKWISALLLLQFFCYFSIGSCGNILVWPMEYSHWMNMKIILEELIQRGHEVTVLIPSSFIFVGVNASSGIKFETFPTSLRRDQLEQFYTRFVSKWMDIGSITTCLSYIPVMEEMFKEYSANWENVCKDVVSNKNLVTKLQQSNFDVLLADPVAPCGELVAELLKLPFVYSLRFSPGFQLEKSAGGLPFPPSYIPVLMSRLSGEMTFMERVKNMICMLYFDFWFETFNLKNWNKLYSEVLGNPTTLYKQMQKSDMWLIRSYWDLELPRPTLPNFDFVGGLHCKPAKPLPKEMENFVQSSDDHGIVVFSLGSMVSDMSEATANAIALALGQIPQKVIWRFDGRKPDTLGANTRLFKWIPQNDLLGHPKTRVFITHGGANGVFEAIYHGIPMVGIPLFGEQHDNIAYMEAKGAAVTLDFQTISTTDLLNALNKVINNTSYKHNALRLSTIHHDQPMKPLDRAVFWIEFVMRHKGAKHLRPLAQNLTWYQYHSLDVIGFLLACAATIIFLVIKCCLFFFQNFVMVGKKEKRE

SEQ ID NO: 7258 - protein, 209 aa, Macrococcus caseolyticus
GLHQKPQKELPTDLKTYLDSSKNGVVYISFGTNVQPSLLPPEKVRILIKVFSELPYDVLWKWDKDELPGRTSNIRISKWLPQSDLLRHPKIKVFITQGGLQSTDEAITAGVPLIGVPMLGDQWYNVEKYVRHEIGVRLDIETLTEEQFNNAITQVIGDKKYRQNIKKFGQIIRDTPIDPLENAVWWTEHVLRHGGARHLRSPAANMSWT

SEQ ID NO: 7259 - protein, 513 aa, Buzura suppressaria
MYLLIIFLWLAKQCHGAKILAVMPTPSYSHQSVFKVYIESLAERGHTIVIIKPTTRVFYDDRFSDNITEIDATMSEFYFSELFTNASVFRKRGIVADSKTVTSANYLGLVHMISNQFKLPAVKQLIEHRHRLQFDVLITEAFIDYPLVFSYLFGDLPIIQISSGHGVAENFETMGAVSRHPLYYPNMWRDRFTNLNVWETINEIYMEMRLQNEFSLLAEEQNKLLAHQFGIGVPTVQKLRDRVQLLLVNTHAVFDNNRPVPPSVQYMGGLHLHKKTIKPMSNYVQNFLDNSTRGVVYVSFGSSITSKNMAPEFLSMIIETFKLVPYDIAWKFDIVPEVNNLPENVLIQDWYDQYSVLHHVNVKVFVTQGGVQSTDEAIDALVPLVGVPMMGDQFFHTNKYAELSIGCAVDTLTVNSLQLMRAIVDAATSAKYRNGLRHLRQIINHQPMTPLHKAIWYTEHVIRHGKNDNTWLKTKAANVGYSDYFMMYILFPLVSVTAMNQLQQLMRLTFFSM

SEQ ID NO: 7260 - protein, 518 aa, Spodoptera litura
MTSTVLLVLLTLTLSLTSNDAAKILGFFPLPSISHQVLFRHLTQELAKRGHEVTVITTDVAFPNGDGPANLTEIDVHDFSYEQWRNLYKLTSTGEKDLIGQIHGAYHMLVKIVEMQLKVDKVQKMLKEEKFDLLLLEACVRPALLLSHVVKAPVIQVSSLGTIDYNVATIGSAWHPFLYPDSLSQRSYNLSIWEKIRELYTYYQLNRVMQEVEDAENVMAKKLFGPNVPTISELKNNVDLMLLNTYPLWDNNRPVPPSVVYMGGLHQNPQKELPKDLKEYLDSSKNGVVYISFGTNVQPSLLPQDRVQMMAKVFSQLPYDVLWKWDKDELPGRSKNIKISKWLPQSDLLRHPNIKVFITQGGLQSADEAITAGVPLIGVPMLGDQWYNVEKYVHHGIGLQLDLLSMTEDDFKNAILTIVNNDSFRQNIKKLRSVMHDQPQPPLERAVWWTEHVLRHGGARHLRGPAANMSWADYLELELVFTVLAVLLGVTLVLFYLMYSIWKYFSNTISPSKKLKKN

SEQ ID NO: 7261 - protein, 405 aa, Bicyclus anynana
MLFHNINVVAAVLSALLLLAGYTESANILHVIPFSAMSHYIFLRHIGLELAQRGHNVTVITTHKEKNPPSNYHQVQVQKKQIWELIGGERPNIFDMAELSSEEFHHKVVWPGGLAFTELTLNSSDVQEFLKKDNTFDLVICEQFVQEALYTLASKYNAPLDLQKLLDESKHGVVYMSFGSNIRSAELPEHKKKAFLNVFKELKQTVLWKWEEDVLEGKPKNLFTGKWLPQQEIIAHPNIKLFITHGGLIGMQEAIYNGVPIVGVPIFSDQYNNVLLAEEVGVGKLLHYNDFNEDTLNKTINEILNNDSYLKTAREVQKRWNDRPMSPLDTTIFWLEYVIRNKGAEYMKNPARNMSWFEYTMLDVYAFILLIIVAVLAFFVKLILIVRAIVYGKQTNKMTKRKKRL

SEQ ID NO: 7262 - protein, 531 aa, Cavia porcellus
MAPVPSPALLPLCLCLLLASSFAQAGRLLVVPMDGSHWFTLRSVVEKLIQRGHEVVIVMPEVSWQLGRSLNFTVKTYPTSFTVQDLDQAFRLFADTQWKTPEQSMYSIAAGSCKRFFDITFSRCRSLFNAKKIVEYLKKSSFDAVLTDPFDVCGLIVAKYFSLPSVIFARTVFCHLLEEGTQCPSALSYVPRLLSALSHVMPFKERVQNIFIHLEERLFCNYFYKNALEIAAEILQRPVSTYDLFSQASVWLLRTDFVFDFPRPVMPNMVFVGGINCQEEKKPLPMEFEAYVNASGEHGVVVFSLGSMVSEIPEKKAMAIAEGLGKIPQTVLWRYTGTPPSNLAKNTILVKWLPQNDLLGHPKTRAFITHAGSHGVYEGICNGVPMVMMPLFGDQMDNAKRMETRGAGVTLNVLEMTSDDIADALKKVIYDKSYKDNIMRLSSLHKDRPIEPLDLAVFWVEFVMRHKGAPHLRPAAHDLTWYQYHSLDVIGFLLGIVLLVAFISFKCCAYGFRKCFGKKEQRKKTQKSKTH

SEQ ID NO: 7263 - protein, 516 aa, Papilio machaon
  MOD_RES (332)..(332): Any amino acid
MTPRLSILYLLCLTLPFIENARILGVFPTPSISHQVVFRPLVHELARRGHELFVITTDPVHPNGPGNLTEIDVHDLSYTRWNKGMSKIEDGSRDVTKQMEAMEQIKYEIFEEQVKSKSVQKLLSYEHDHFDLILAEAYVGYTLGFSHVFKAPVILVSSFGGVWDNYDAMGAPTHPLLYPSMLRDRLNNITMWEKIIQLKKEHKMRHLARNYEKMNKFLKKVFGAGTPPVQKLFDNVAMLFLNVHPIWDSNRPVPPGVIYMGGLHQNPIRDLPKDVKLYLDSSKNGVIYFSLGTNVKPSHVPPEKLQAIINVFSRLPYDVLWKWDNDELPSRXNNIKISKWLPQSDLLRHPKVKLFITQGGLQSTDEAITAGVPLIGIPLLGDQWYNVEKYVQHKIGVRIDINSLTEEMFENAIHNVINDKSYRENIVRLRSIMQDQPQSPLERAVWWTEHVLRHGGARHLRSPAANISWTQYLELELLFTLATVLILSLIILFLVIKMVWSFVNSNVTTKMKIKKP

SEQ ID NO: 7264 - protein, 515 aa, Wasmannia auropunctata
MKITTTSLVTIVCLLSMVNGARILAIFPFNVKSHYIVFEPLLKRLSARGHEIVAVTHFPQRIRLANFTDVDVSSALPSRINTIPLINITIWQSILRFMSSEFCEFVLSHPEIKRIINAKEHFDLLVIEMFASDCFLGIAHALNISKIVGAISSAGLLRTNVMLRNPENPSYIPNYFSSYTGRMNLLERSFNTVLLLIVNSGFRILSDRSSYEVARKYLGHDLPDFDALRSRISLILTNGHPAVSVARPLAPGVKEIGGIHIPISGPKPLPMDLQDYLDSQSRNGVIYFSLGSQIDTSTIPNQVFAALYRAFEQVPQQILWTCAKERMPPLPGNVKCIGWAPQLSVLCHSNTRLLIYHGGLLGLQEAIYCGVPILGIPVFGDHRLNMAYVVEKGLALQLDLQQFSYKRFSSSLNEILSNKSYTEMARKASFQFKDRLMSPVEEATYWVEHTIRHDPNFLKTAAIELTWYEYLLLDVALMMISIIVFALWLICKLFSLLFSKKKIIIIIEDNVKKIK

SEQ ID NO: 7265 - protein, 449 aa, Homo sapiens
MPQDRTEENEIFVDLALNVLPGLSTWQSVIKLNDFFVEIRGTLKMMCESFIYNQTLMKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKEMENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLACVATAIFLFTKCFLFSCQKFNKTRKIEKRE

SEQ ID NO: 7266 - protein, 506 aa, Camponotus floridanus
MRMLKIMFLWSFCLSVCHGYRLLGLFPFHGKSHFVMFEQLMKGLARKGHQIDVISTFPLKKPYPNYTDIVKLTPPHVFVNNVSYEFMQVLLSANPVYSIATMAGNDICKHLENPAIQELARNPPKDPPYDAVLMEVFGAQCFAIFPYLWDVPLIAVSTTALYPWLPPLIAQPENLAFVPNNKNQKTWLSKLYFNYLTREQSEIIRKHFGPNLPGIRELETKIALMLINSHFALNGIQPKTPAAVDVGGLHIQDEDSTLQPELEEWINDSKDGFIYFTFGSMVMIETFPREFLNILYASLSKIAPIRVLMKIPNPEKLPPGVPKNIYMSPWMPQIKILKHPKIRAFITHGGLLGTLEAIAYGVPMIGIPLFADQFMNIDAYVARNIAVKLDLHKMTEKDMDRALNAILWDPIYKETVRNFSQIFLDRPLNALDTAIYWIEYVIKYGSNVLRSPAMDLTWWELSLLDVFAFLLFCAAIIIMTVVFIVNFLLKILNGNDHNSLHSKKNN

SEQ ID NO: 7267 - protein, 502 aa, Oryctolagus cuniculus
AAAMDFSHWINLKVILEELQLRGHEITVLVPSPSLLLDHTKIPFNVEVLQLQVTKETLMEELNTVLYMSSFELPTLSWWKVLGKMVEMGKQFSKNLRRVCDSAITNKELLDRLKAAKFDICLADPLAFCGELVAELLNIPFVYSFRFSIGNIIERSCAGLPTPSSYVPGSTSGLTDNMSFVQRLKNWLLYLMNDMMFSHFMLSEWDEYYSKVLGRRTTICEIMGKAEMWLIRSYWDFEFPRPFLPNFEYVGGLHCKPAKPLPEELEEFVQSSGNDGVVVFTLGSMIQNLTEERSNLIASALAQIPQKVLWRYTGKKPATLGPNTRLFEWIPQNDLLGHPKTRAFITHGGTNGLYEAIYHGVPMVGIPLFGDQPDNIARVKAKGAAVDVDLRIMTTSSLLKALKDVINNPSYKENAMKLSRIHHDQPLKPLDRAVFWIEFVMRHKGARHLRVAAHDLTWFQYYSLDVVVFLLTCVATIIFLAKKCCLFFYRRFCKTGNKRKRE

SEQ ID NO: 7268 - protein, 484 aa, Dufourea novaeangliae
MFEALCKGLLRNGHRIDMISHFPSAAPISNYTDVIDLTGTRDHVVNSFSIDHGTSLQKSMTYNIATEFGGDLCHLMGHETMQKFIENPPNDPPYDLVITEYLGAVCYLGFGHLLRVPVAIASSFLQVPCIHDFMGNNHNYAFFSGAYNEGATLVTFPDRLWNFLSNFMEMQLFYYYTSDQTKVMRKYLGQDVPDVRELERTVALALVNGHHSVNGVRPITPAIVDVGGLHVEFDHSELTRDLKIWLDSANDGVVYFTFGSLTNIETLPRDTLLDLYASFAKVTPVKVLMRCANASKLPPGLPSNVLIKPWFPQVPILGHKNTRVFITHGGLMGVQEALYYGVPLIGIPIFSDQMRNINIFVEKNVAIAINLNNLTKNSMDAALNAILNDPKYKEAAQKASRSFRDRPMSAMDTAIYWIEYVIRNGPESLRSPMIGIPWWKRNLIDVLGFIVSYLVLCVYVSRIFFKASIRKLYGSTHQAKKKLN

SEQ ID NO: 7269 - protein, 884 aa, Bicyclus anynana
MLSGIHGARILAYFPTPSISHQLVFRPLTQALAARGHEVIVVTTDPVFPKGQTPANLTEIDVHDISYEIWGSLYKYHRGNKRELLVQVKAFFEVFTNVFYRQAQTTEVKELLNKDRKYFDLLLLEACNRGLMGFSHIYDAPVITISSFGAVPAQYHTMGAPVHPILYPTAGRQRLYKLSLLEKCIEMLGYYLFDFLVSDSNAYEHKIMKSIFGEDVPTFPELKNNVELLFLNEHPIWADNHPVPPSIQYIGGIHETKYKDLPADLKKYLDSSKNGVIYVSFGTNVLPSLLPPEKIEIMAKVLSQLPYDILWKYDKDVLPIQSKNINISKWFPQPDLLRHPKIKLFITQGGLQSTDEAINSEVPMLGIPMLIDQWYNVEKYVHHNIGLQLDIMTLTEEEFKQSIEKIINDESYKKNITRLKTLMREHPLKPLDNAVWWTEHIIKYGGNHLKSPAADMSWTEYYEVELVLILFAILITILTVLGWIMKSVLKFMYNIYRTNIKLKNTKIVIVQTLHVNSNTIAIFVHPAFNEKQRPANLTEIDVHDISYKIWQEYALTANGDDNNLEDKSVIFLSVIFNLFERQLIIWDNNRPVPPNLIYVGGIRDNPAHDLPKDLQSYLDKSTKGVVYMSFGSIIQTSLFSQEIIELFIDVFSKLPYNVLIKWDSELPGCPDNVKVGKWFPQTDLLRYQSMSESIDAGIPIVGIPMAADEWYNMELCLKHGIGVKLDFKYLTKQNIKGAINTVIGNECYRDNIIRLRNLIHDQPQSPLDLAVWWTEYVLRHGGATHLRSAAAHMRWTEYYEINLILCLLLLILIFTFSIIYSVKLFINKLIKQLVFIYTSGSCYRRQSVTSRRQATASPTTVSDVSAEGDGVADCSQWRLGGRQQ

SEQ ID NO: 7270 - protein, 520 aa, Spodoptera litura
MFQLSNLFAFSAFLEFAVESARILAVLPVPSISHQIVYRPLTQELASRGHEVTVITPDPAFPKGKTPPNLTEIDVHDSYKIWIATLNKIPKNKERNVLEEVKLFLELGYEVSDAELSHEDVKALIKSKKEDYFDLLIIEASETIFLGFSYIFKAPVILISSLSLSYDEIDMIGAAIHPILYTSINRIKNSHDLTPWDKMKEFYNYYKYLKMYERYEIRKHAMLKKHFGPEVPPISVLKNNIDMFFVNVNPIFEGVRPVPPSVVYIGGLHHKPNKELPVDLKAYLDTSKNGVIYISFGTNVDPTLLPGDRIEVLVKTLSQLPYDVLWKWNGDVLPGRTDNIRIAKWLPQQDLLGHPKMKLFITQGGLQSTDEAIIAGVPLIGIPMFGDQIFNVERYVYHRIGLKLDLDTLTVEQFRNAIETVLGNESYRQNVVSLRNKMYDQPQPPLERAVWWTEHVLRHVSARHLRGPAANMSWSEYLELELVFTLLLGLLTVLTLSILVMYFTWKCVLSKYLTFKIKSD

SEQ ID NO: 7271 - protein, 519 aa, Bicyclus anynana
MAITRCILFYVIVFIITGIDSARILAYFPTPSISHQIVFRQLTHALVARGHEVTVVTPDPFFPKGKSPANLTEIDVHDVSYEIWEDLLQLHRGNKQDILLQVRSLFEKFSTILDAQLQTPEVRAIFKKDRKHYDLLILEACNRAVLGFSHIFDGPVITISSFGAVPMQYGIMGAPVHPLLYPTAGRQRLYNLSFVERAVELIGYYVFDFLILDTDHYDYKIMQKNFGNNVPTYFELSNNIQLMFLNEHPFWADNHPVPPSVVYIGGIHEIKEKGLPTDIKKILDSSKHGVIYVSFGTNVLPSLLPPEKIKIMAKVLSNLPYDVLWKYDKDVLPGSSKNIKISKWFPQPDILKHPKVKLFITQGGLQSTDEAIDAAVPVIGIPMLVDQWYNVEKYVYHNIGLQLDITTLTETEFKQSVETVINDKSFKRNITRLRTILREYPIKPLDLAVWWTEHIINHGGNHLRAPAANMSTLEYYEVKLVLIIVTIFMSIIILLGWLIKSSFKLMYYLYKSNIKIKMH

SEQ ID NO: 7272 - protein, 518 aa, Ooceraea biroi
MRVLPMILVSLLWLLLCTAHRFLVVVPPLSQSHYIMLESLMKGLANKGHQIDVISPYPQKKPYPNYTDIAKWATEEYVNNVTYEFVQVLAGSNPKIFATLFGSNICEAHLGNPVIQKLVRDPPKDPPYDAMIMEVFGAHCFAAIAHLLNIPLIGVSTTTLYPWLNELIAQPENLAFVPNNFMNVEFPMNLWQRTYNVFSFLYYKAYFNYLSRSQDDLVRKYFGPNLPSVRKIKLALLLVNSHITLSEIQPMTPAVVQIGGIHIRENDLPLPHELKKWIDDSKDGFVYFTFGSMVLIETFPRKILNVFYTSLSKIAPMRVLLKVPNPEKLPPGLPENVYTFSWVPQLKVLKHPNIRAFITHGGILSILEAIANGVPMIGMPLYADQFKNVDASIARNIAVKLDIQKMAEEDMDSALNAILHDPRYMENIRNLSQRFHDQPLSPVDTANYWIEYVIKYGDDVLRSPAMDLAWWQICLIDVAACLLLCMAVIIIVAVSIMRFIVKMMNRNHRKLLHAKKTT

SEQ ID NO: 7273 - protein, 533 aa, Orcinus orca
MTAGSRGPRPLILGLLLCALGPALTQGGKLLVVPIDASRWLSPPGIVQQLQHKGHDIVVLPPHASMYVKEGAFYTLKRSPPPFRREDLEVAFINLGHPPFENDPFLQRMVKIYKKPPHDSALLFSACSHLLHNTPPMSSLAEGSFDAVLTDPFLPCGPIVAQYLAVPAVFPPHGLPCSLDFQGTQCPNPPSYVPRPLSFNSDRMTFLPPVKNILIALSESFLCNVPPPPYAPLASEVLQKDVTPPPLMSYASIWLLRSDFVNNYPRPIMPNTVFIGGINCASKKPLSQEFEAYAPPSGEHGIVVFSLGSMVSPPPEQKATEIADALGKIPQTVLWRYTGTPPPNLAKNTKLVKWLPQNDLLGHPKTRAFITHSGSHGVPPRICNGVPMVMMPLFGDQMDNAKRMETRGAGVTLDIPPMSSKDLENALKTVISDKSYKENITPPSSLHKDRPMEPLDLAVFWVEFVMRHKGAPHLRPAAHDLTWYQYYSLDVIGFLPPPVLTVIFVTFKGCAFAFPPCFGKKERVKKSHKSKAH

SEQ ID NO: 7274 - protein, 533 aa, Trichogramma pretiosum
MKSFKIIITVLLINLSISRAYKILAIFPFHAKSHDNMLSAFAKGLAERKHQVDVVTHYPAKNPPETYRIVVNLSGTEPPIINSFHIDYAKTIAQDVTVKVADRYGSDLCHYMNLPDFQKLTKKIKSSKDKLYDLVVLEAFGSSCFMGFGHLLKVPVIGISTLVEFPWISDFIGNDDNLAYVPSCSTKYFDKTKFWDRLMNLLHYHYEKFRFHSKTEKIQTELMRKYLSPDMPNVREIEKQIALTFVNRHPVIFGIKPLVPSLVELSALHMEEDPKLPDLQKWLDESNSGVVYFTFGSMVLIETLPKHQIFEIYNSLRKLNQRVLLKIADPTKLPPNLPENVLTSPWIPQQAVLKHKNVKLFITHGGLMGSQEALYYGVPMIGIPLFGDQPINVDKFVQMKMSLKIDFDNLTTNSLDWALNEIFTNYKVYKERAEYNSRLFKDRPMSPMDTAEYWIKYVIRYGAGPLKSPALELNWWQLSMLDVYIFLLIFFSVIVFFLCILIQLFFNLIKNRISIKHVSKTLSENSSKKVKYN

SEQ ID NO: 7275 - protein, 510 aa, Caenorhabditis briggsae
MHTTNLLTFLFFLGVSSGKNILIFNPIFGFSHVKFISLMADIIADHGHNVIINYYPDHYEELEKLETETFPGFWDSHLMNNPVLQAFMMPRSLVLQFERTAAQLLKDQKTLDELRSKKFDVVISETFEITGFYIAHLLELPCIPIMSAVRFTTFNELFGQPSSLGYLPAIGSNMAPEAGLFDRINDVFRNFLMLSCMERMSDLQQTFIENAIGRPVPHWRDLIKQSPIYITNSNPYLDFAVPTTATIVHVGGITMDLKQMKHVGKLPEEYVPILNERESTVLISFGSVIRSFQMPDNFKAGLIKMFQSLPDVTFIWKYEKDDVELKNKLPKNVHLKKWVPQPALLADKRVKVFVTHGGLGSTMEVAYSGKPALMIPIFGDQPWNAVMLARHGGAIAYDKFDLQDGEKLTRTMKAMITNPKYQEKAQELLEILSNQPIDPKLNLMKHLEFAMQFPNLRSQIPAINQVGIIAHYYLDAIAFIAIFAVLSVYGTYIIICKLPIRLVSKKVKSE

SEQ ID NO: 7276 - protein, 526 aa, Orussus abietinus
MAGKKMLISLLLVFGVFASGETYRILGLFAFNGKSHFVMFERLMKALASRGHQVDVASTYPLKKPYPNYTDIIVFEQPNGAWVNNLTFSTLQNDFLVFRIAPMVGHIGNDICKNMKNPDLQAIVKNPPKDPPYDLVILEIFAAHCFVAIGHKFGVPVIGVSSSDLYPWGNRLVANPENLALVPTNLAPQLDLRFFWNRLTNVIDAWIDTAEFDYETTSIQNEYIRKYVGPDVPGVRELEKTIALILVNTHISINGIKPTTPALVEVGGLHIHDDGPDLPQDLQQWLDESKDGVVYFSFGSMVRIETFPRDILLAIYQSLRKIAPVRVLMKIPDPRDLPPGLPDNVLTRPWISQLKVLNHKNVRAFVTHGGLMGTQEAIHYAVPMIGIPLFADQHLNVDFYVEKKIAVKVDYKTLTVEKMDAALNAILYDPTYRETVKELSDRFLDRPLSAVDTAVFWVEYIIRNGGDSLRSPALDLAWWQEALLDVFAVFLSAILVLIYLAYLLIRLLARILRRNRLKANLSKKNR

SEQ ID NO: 7277 - protein, 317 aa, Ancylostoma ceylanicum
MSRLLNGLLFLTVCSCYKIVIFAPEISNSQVGWNKRFAETLAKAGHDVTVILLQSMEDAEKDVQFSKDVKVGRRGTDSAMEADRIDSIFLNFWVTAHLLTALDPCPGVSRLLDADPPLPHHGTQLQVMVNSNELYELPRPTLSKVVHIGGLGVEYEDAKPLQGEFKQIADSGKGVVVMSFGSVAHAEMMPEQWKTAFLNAFAQYPEHEFVIKYANDDLKHRLPPNVHTYRWLPQADLLLHPSTKAFISHGGYNSIQESINFGVPLITIPLFGDQFKNSKIAAKHGFAVNLKKGTLDEASIAAALKEVLNNETNIKEF

SEQ ID NO: 7278 - protein, 526 aa, Leptinotarsa decemlineata
MDLLHYYISFAAIFLVVPIESANILAITFVPSVSHQEVYQPIWRELSLRGHNVTVMTTNVLADPSLVNLTQIDVSFVYKYMNVPLKSFRDATILQNIFFIDFFFSKLLQAEIAHEDVQKLLQRDDDEFDLVVLEALHPLVYGFAAKFKAPVVAISTLEPFIPFHDALGNPTHPVLRPDNFIHFYGEPTLKDRMTSFLHNIFYRAIYYWRLLPEADKVARKFFGRNIPYLGDVIGNTSLMLINSNPILNTPVANVPSVISFGNVHIKEAKPLPKDIQKFLDASSRGVVYFSLGSNVKSTSLGTEMRDIITQALSELPFNVIWKWEEDELPGKPDNVLLKKWLPQQEVLRHPNVKVFVTQGGLQSIEQSIAFGVPMVGIPIYGDQPTNVKTLVDGGMALFIDFKSITKDELKKAILEVGTNIKYRERVVKARELIQDQPMNGLDKAVWWIEHVIRHKGARHLRSPAADMPIFQYFMVDVIAILLFGLYLSVKLTKLIIRWTVRGLTIGFEVFKKFLNNKLLASKQKAS

SEQ ID NO: 7279 - protein, 520 aa, Drosophila mojavensis
MPISRLFISLLFCVLPQLLEGARILAIFPFPGPSQYINVVPYLKGLAARGHQVTSVNAFPQKKPVENFHDIVVPEVFQSYEEIIADLEISRNSWEENSFVNDFFLSVTKTVLQNAKVQQELLQPGKAQFDLIIVEALRTDALYGFAAHFNAPIIGISTFGTDWNIDELVGNTSPISYIPLITGGLTDHMTYWERVHNFVETAIAWLNWKLVYVPLHVKLYEQYFPHIAHKKPLVELSKNFSLVLLNQHFSLSFPRPYVPNMIEVGGLHIAHKPAPLPKEMEEFIQGAGSTGVIYFSLGSNIKSKDLPEERKQMLLQALASLPQRVLWKFEDEQLPNKPPNVFISKWFPQPDILAHPNVKLFITHGGLLSTIESIHHGKPVLGLPFFYDQFLNVERAKQAGFGLALDHKQMTGAEFVQTIKRLINEPKFSETAKLMSARYRDQPMSPQETAIWWTEYVLRHKGAPHMRIAAQDLSFVAYHSLDVVGLLLGVAVLMLVIIFYLLQRLLCSRGGAGKQKLKNQ

SEQ ID NO: 7280 - protein, 512 aa, Papilio xuthus
MKTTVLLWMFLTISSISAYKILCILPAPSRSHATLGRGIVNTLLEAGHQVTWATAYLDKSNNKNLRQIEISKSRDVVEGMDVTNQGRMSVSLVREFARNISIAALETSELRDVLINEKFDAVVTEWFFSDVEAGYAAVQQVPWILLSGVVMHPYLEYLVDSVRSLPVTPFMMNDFPVPMDLWDRLANTYSFGMFMFGNWLESTTSEGDYEKHFSSIAKARGVSLPPLSLARHNISILLVNSHSSFAPAQPLPPNVIEIAGYHIEETTPTLPKDLQDLLDSSRNGVVYFSMGSVIKSAALPDSTKRELLRVLGSIPYTVLWKFEEQLEGLPKNVHIRSWMPQASILAHPNVKLFITHGGLLSTLESLRYGVPLLAIPVFGDQPGNAIRAMRSGYARKVNFSPDMAPELEKELKHMLSDDTYYNKAKELSMLFNSRPVTQRKLILHYVELAIESKGAYHLRSKSQLYKWYELWMLDQLAVVFAALFLLYLLLKKIVSVLTKKNVKEVKKSKKNK

SEQ ID NO: 7281 - protein, 530 aa, Caenorhabditis briggsae
MHLNYIFHIFLLLISVHAKNILIYNSVFGYSHVKFLSLMANIIADHGHNVTLFRPYHINHNTEGLIKNKNIEIIDYFPDHYEELLHANSETFPMFWDDPFVNHPVLEAFIAPRLISQAVEKTATQLLKDGNIIQELKAKKYDVVIAELFEITGVYIAHLIDVPCIPIMPAVRFTNTMDIFGQPSLLGYIQHSGSKMAPDAGFLDRLNDVYRNFLFDLNTDLNSYHQQKVFEKAVGKSLPSWKDLVKQSPIYMTNSNPYLDFAVPTTATIVHVGGITVDLNKPKTVLSDDYEKILQERESTVLISFGSVIRSFQMPDNFKAGIIKMFESLPDVTFIWKHEKDDAEFQKRLPKNVHLKKWVPQPALLADKRLKAFVTHGGLGSTTEVAYSGKPALMVPIFGDQPYNADMLARHGGAIAFSKYDLKNPEKLTSAVKSLVYDLKYKNNAEILLDVLSNQPIDPKLNLMKHLEFAMKFPNLRSQVPAINQVGIISHYYLDVIAFLTILVVLSLYVFYVLLRKFFRRVVSGKLKNE

SEQ ID NO: 7282 - protein, 1056 aa, Spodoptera litura
MSLVNLLAVVACFALSVPSNDGARILGFFPFPSISHQVVFRPLMHELARRGHDVTVITPDPAFPKGGTPANFTEIDVHDASYRLWHEQFVATPKGQKGNLVKDFNIIYKLTVKIIDTQLKDAEVQRLLNDKNQTFDLVIVEAMMRPAVVLSHIYKAPVILMSSFGTFSDNYAVMGAPIHPFLYPFTVSRRLHSTSLWDKIGHLYDYIMIEMIHRNNYIEENRMLRSHFGPDLPLIEEINNNVAMMFLNLYPVFEGNHPVPPSVIHMGGIHQIPDKPLPQELKSYLDSSKNGVIYVSFGTNVDPALFPPEKIATFVRTFSRLPYDVLWKWNKDELPGKTDNIKISKWLPQSDLLKHPKIKAFITQGGLQSTDEAITAGVPLIGVPMYGDQWYDVVKYEKLKIGVKLELDTINDEDLENAIHKVIDDDSYRRNIKKLRELMTDEPMSPLERVVWWTEHVLRHGGASHLRGPAANMSWTEYLELELVLTLLLALIITTATIVLLAKYIYDKVLRKYVDVIKIKRATLFNSRLQSSRSRTMALPLFIVTCFTLAFVPNEAARILGVFPVPSISHQVVFRSITQELARRGHELVIITPDPAFPKGKTPANLTEIDVHDVAYKMWRDDIQDIAIGEIHGILSEYAIIMKLMAKVLDVELKEEQVQKLLNDKSQKFDLILAEACVRSAVVFSHIYKAPVILISSFGPFLDNYNVMGAPSHPLLYANNMSRRFNNLTMWDKIVKLYYRYNIEVMLNKNYAYENNMLRSHFGPDLPPIEEMYNNVAMFFLNLHPIFEGNYPVPPSVVHIGGIHQGPEKELPKDLQNYLDSSKNGVIYVSFGTNVEPSTLPAQKLKVLVDVLSRVPYDVLIKWNKDVLPGIGSNIKLSKWLPQTDLLRHPKVKLFITQGGLQSTDEAILAGVPLIGLPMWGDQWYNVERYERLRIGLNLDIKTLTEEVFENAINDVIQNESYRRNIQRLNTLIRDQPQPPLERAIWWTEHVLRHGGASHLRGPAANMSWAEYLELELVLVIALVLLLALALSILAFYYFYNNVLRQYLIAGKVKRS

SEQ ID NO: 7283 - protein, 416 aa, Spodoptera litura
MTCDPCFDCIHNHRNEYQVVSSVCLRTNHWHAQNNNARVKIALVLSQVVDAPVIQVSSFGPMNFNVETMGSAMHLFLYPNHMRQRLYNMTTWEKLLELYNIFRIEKAIEEVEEAENVMGKRLFGPNTKTISELKDNVQMLFLNIHPLWEGNRPVPPSVIYMGGLHQKPVKELPTDLKTYLDSSKNGVIYISFGTNVQPSLLPQDKIKIIAKVFSQLPYDVLWKWDKDELPGRSKNIRISKWLPQSDLLRHPKIKLFVTQGGLQSTDEAITAGVPLLGVPFIGDQWYNTEKYEHHGIGIKVDFSTLTEDIFKKAINTVLSNKSYRQNMERLRSVMYDQPQSPLERAVWWTEHVLRHGGARHLRGPAANMSWADYLERELVFTLLGIVISIVLALSFLLYKLWRCMNPSERQNKVKKN

SEQ ID NO: 7284 - protein, 558 aa, Neolamprologus brichardi
MQFQSDWICSQTQDLFVVSHMMQVSTSLPLLLLSLTLLLLHPVSPVHGGHVLAFPGEFSHWLNMRTIIEELVKRNHSVTILVPDASPSVNYNNSRDAAKFNFLVFKVSYSREEYVGTLHKFIQFSMYESHTSSPLQKIMKMNHFMGRTLDFGRQQCDGVLKNQQLMATLQDSAFDVILQDPFAMCGDLLADMLGVPLVLSLRFSFGSVMERHCGHAPLPPSYVPLAPLPYNDHMTFTERLINMVTYVASSMLTELAWKLSVNKYYSEIKGTPSSVCETMGKADVWLIRTFWDIETPRPTPPNFKYVGGLHCKPANQLPEDLEAFVQSSGDAGIIVASFGSMVTNLTMQHANIIATAFGQIPQKVIWRYRGEPPTALVPNTKISDWIPQNDLLGHPKTKAFVTHGGTNSLYEAVFHGVPLVGVPLFGDQPDNLARMSRRGTAIVLDFNHLTAEELAEALHVVTNQPSYRTNMKRLSAVHRDQPVTPLSTAVFWVEFVMRHGGARHLRLASYDLNWFQYHSLDTGAALLVALMTVAALWWVGIRCILRQCRRRAGREKKD

SEQ ID NO: 7285 - protein, 734 aa, Papilio xuthus
MRCGIIVIIFAVLASRSTECARILGLFPHIGKSHYIVFQSLLQALADRGHDVTTVSFFPIKNPPPNYKDVSLEGISDLGLEVLDLSLFEFPPVFMKIPVISVLLKAKVEINMLGDIGLGVCEQLVQLPSLAEVMKKEYDVILTENFVSDCMMGLLHVYGNKAPVIGLSSSTFMAWVPDRYGVNDNPAYVPVITCPYSTTMNFIQRLGNFIVNVYSKYWFYEYFQKEERSIIEKHFNTKIPDLEEISRNQSVLMLVNSVPILNGAKPTVPSVIEVGGMHLDHTRKELPSMVFEPLLRTLAERGHHVTTVSFFPLNNPPENYTDISLENISEVLLESLDLSLFESNGVISKIPVARRVLGLMFEFQPLAHFALHVCENMIQWEPLANVLKMEYDVILMENFNSDCMLGLLHIYGNTAPKVALSSSNLMPWSVQVKEQSLIEKRFRKVIPDLRDLSRNYSLTLVNTFHALNGVRPLLPALVEVGGMHLDHTHKPLPSYIEKFLNESEHGVILLSFGSLIKTSTIPKYKEDMIVNALGKLKQRIIWKFEGSGEEGTLTGNILRVKWLPQYELLQHKKVVAFIAHGGLLGMTEAVSAGKPMVVVPFFGDQPANAAAAAEAGFATVVPYIELTEEKLIKALEFVLSAETRLNARRVSSIWRDRQADPLETAVYWTERVIRWGHHAQLHSPARDMPLYQIALLDVIATLAVAILILLAISWYILSKVFRLLFGRESKLKMQ

SEQ ID NO: 7286 - protein, 524 aa, Drosophila virilis
MFSLRLCCLLPLVLLLPSLLDGARILAIFPFPGPSQYINVLPYLKGLASRGHEVTSVNAFPQKKPVKNFRDIVVPEVFQSYDDIISNIEAYRNVWQENTFINDFFISITKKVFENAEVQRELLKPGKAQYDLIIVEALRTDALYGFSAHFNAPIIGLSTFGTDWNVDELVGNTSPISYTPLVTAGLSDHMTYWQRVRNFFETAIAWLNWKLMYIPVQNQLYEQYFPHVAQKKPLAELSKNFSLILLNQHFSLSFPRPYVPNMIEVGGLHISHTPAPLPKEIEEFIQGAGSAGVIYFSLGSNIRSKDLPQERKQMLLKAFASIPQRVLWKFEDDQLPDKPANVFLSKWFPQPDILAHPNVKLFITHGGLLSTIESIHHGKPVLGLPFFYDQFLNVERAKRAGFGLGLDHKEMTTSEFKQTIERLINDPKFSTTAQLMSARYRDQPMSPQETAIWWTEYVLRHKGASHMRVAAQDLSFVAYHSLDVFGMFLVVGILILVTIYVVLKKLLCSLQGQQVSGKDKLKHH

SEQ ID NO: 7287 - protein, 526 aa, Microplitis demolitor
MYSLKIIFIATVAMVFYAQPTEALRILGIFPLPGRSHFIPAAQLLKGLAAKGHKVDVVSHFPLSKPVPNYTDISLKGMLRIATNNLTYNDTRQFNSFSMYQFTYMTGIEVCGLLNQPVFEKLLKTPKGTYDLIILELFGANCYLPFGQHLGAPVVAMVVSKMHDWLYGPFGVPFNTAYTPSLFSSFDQSMTFLQRLQNTLVSSIIVAQINYYMEIQKTYVEKYFGRKVASITDLYDEVSIVLLNSHHSLYDIIPTPPAIIEVGGLHVHDDQQELSPEIKKWLDESKDGCVYFTFGSMVRIETYPAATLEIFYETFKKIAPVRVLLKITDPKLLPPGLPKNVMTSPWLPQVAILKHKNTKAFITHGGLMGTQESLAYGVPMVGLPIFGDQYTNLQVYEKRKIAVVLKHEDITVESLTKAVTTVLNDPTYRDNIKRLSKLFLDRPMSALDTAIFWVEYTARHGNILKSPATKLSWWQYYLIDVYGFILLCIAVVLYITKHLIKLLYRLICSRKSSQNKTPVAKSKKNK

SEQ ID NO: 7288 - protein, 513 aa, Helicoverpa armigera
MMSLALCILVISITYNDAARILAVFPVPSISHQVVFRPLTQELARRGHEVTVITPDPVFTNEEAPANLTEIDVHFTYDVWKKFYETTSGVNNDLIEQTHTAFDLMNRIFEVQMKVDKVQKILKEQKFDLLLLEACVKPALVLSHILKVPVIQVSSFGPIFFNSATVGSAWHPLLYPINYVLKLNNLTKWDKLKELWSLYKIINVMQQVEQEENKTVKKLFGPDVPPMSELKNNVDMLFVNIHPLWDSNRPVPPSVIHMGGLHQKPQKELPQDLKSYLDSSKNGVVYISFGTNVKPSRLPREKIQILIKVFSELPYDVLWKWDEDELPGRSSNVRIEKWLPQSDLLRHPKIKVFITQGGQQSTDEAITAGVPLIGVPMLGDQWFNVEKYITHEIGVRLDIETLTEEQFKNAITEVIGDKKYRQNIKKFGEIIRDEPMTPLERAVWWTEHVLRHGGARHLRSPAANMSWTQFLELELVFTVLSVAIGFVLLLSFLLYYSYKHFVLIPKHKKIKGN

SEQ ID NO: 7289 - protein, 466 aa, Heliothis virescens
MSVLIVTFVFCSLFINLTEPARILAVFPVPSISHQVVFRPLTQELVRRGHEVTVVTPDPAFPKGQRPANLREIDVHELYGVWKKKIMTFPEQNKDNLLGQVKMFLDIGYSAIDAMLYNEEVRDLIENKSDQFDLLMLEACLRILLGLTSVFKVPVIQVSSFSASYSNFEMIGAPINPILYPSINRKKNHNLTMWDKIIETYNHYQVARINEEYEKLEDILLKKHLGSKTPPLAELANNVDMLFLNVHPVFEGIRPVPPSVVYMGGLHQKPDKGLPKDLKTLLDSSTNGVIYLSFGTNVDTTFVTEEKLRIFVNVLSQSPYLVLWKWDAETIPGQSENIKLSKWWPQSDLLKHPNVKLFITQGGLQSTDEAITAGVPLIGVPMMGDQWLNVEKYVHHKIGVKVDMETLTEEHLKNAIETVIGDGSYRHNVVSLRNKMYDQPMTPLERAVWWTEHVLRHGGARHLRSP

SEQ ID NO: 7290 - protein, 345 aa, Trichoplax adhaerens
PNPLAYIPQLGFAASNKMTLYQRTINVIIYYVANAVAHLVILPQMYNAMNTSNLGINSTPLFTERRSSFLIVNTDFAIDYSRPITPTSKVVGPILPKPAKPLPDDLQQFMASNPKGTVLVSFGSVVTALKYVTNITMLFDTFGQLPYNFIWKNTEELPDNIAPNIKIVKWVPQNDILGHPNTKAFITHCGMNSLLEGAYHGVPMVGIPVAGDQVIHATKISSKHVGVTLNVKEMTQSDLYYAIMNVTTRQDIINSSMQVSKLIQNRPNGRTPVEEAADWMEYALNCDGGEYLRTEEYNLRWYELHLIDVYAVLLVLLAIMVKILQLIWRGVKALCCAKAPKEKIS

SEQ ID NO: 7291 - protein, 401 aa, Lingula anatina
MFVDKELDRKVRELKFDLMIVCGYWFFAKAYLFPHRYAVPYVSIVLDMQQLAGVPMLPSFVPSLAITAKYSDKMSLPQRMLNIVPYVLLKHSIQPITPELSQKHAPGRPYMSTPELMAESELWIVDGGQPAIDHVKPSLPNVKYLGGLVTRPAKPLPKDLETFLKKHDHGVVLVSFGSLVKYMPDRVVQELFEAFKNVPYGVIWKYNGQPLKNVPDHVKIVSWMPQNDILGHPNTKLFITHAGNNGQMEALYHGVPMISIPLFGDQDYNAARAEQKGIAITMDAAFLKSEDLISAINMMMENETYAKNMRRASAIFRDQPGTPVELAGFWIDHVIKYGGSYMKSHARLLPWYQFYMLDVMLVFLAMILLICLFCGVCCSFVCKKLRGQSTSAGKQKTQKTE

SEQ ID NO: 7292 - protein, 516 aa, Heliothis virescens
MHLYKLIIYLLYLVVYSNGYEILAVFPHSARSHHIYFSALVEELALRQHNVTVINYHPVQKIPTLRQISLQNKENASACVDIEKRMEVLSVSDFALAYATAKVFKNIANTNCKKLMNHREVQELIESSSHFDLVIVEQFVTDCGLAVAYKLNAPAIGIAAHILSPWTYPRLGAPNNPAYVPNHFFGSGSKPTLWNKIKSLVINLGMNMYYTHVIQRSDQEIVNEVYPDTPLLEELGKNMSLILINQYFPLTGPRLYSSNVVEVGGLHINLNDHVAEDEGLLNFLDSASNGVVYISFGSVASNFPRKISNEIMKLVEKSNMRFVWKTDISDWVPPSNVLIGKWMPQTAVLCHPNVVGFISHSGMLSTSEAMHCGVPLVSVPLFGEQFANGRSAVESGLGVLLDVLTLNVHVLEDALKTILQEQYQKKAKTLSKLWKDRPLSPMETAIFWIEYVARNKEAVNLKPPTLDMPLYQYLMIDVLLVMALATLVIGYIIVKLISLVFIIVFEDHKLKGKKVE

SEQ ID NO: 7293 - protein, 545 aa, Diuraphis noxia
  MOD_RES (147)..(147): Any amino acid
MLSEHNHAACAGVHNNNKIYKMKHLFFVVLILFYVHHCLSANILAFLPTFARSHYGGFQPLLKELAVRGHNVTVLSHFALKNPPPNYHHIDVSKERQNDNNFSMLSIAPYLKPLIIPIGTLFFGSQITLETLNNTKVQEFIHSDGYXFDAVIFENFQHECFVSMSHKFNAHAIQLFPATPTAFTSQWYSQPFNPSYIPDPNSGYKDHMSLFERTINFLVTCLQFILFPIFYMPKQNEIMLNHFNYTGSEFRPSLEEMMKNISLTLINTHFTLGTARPLVPSFIEVAGMHLKPASKLPKDLQELMDNSPDGVVYFSFGSVVKGSHLPTHQVEMFLRQLGQIKQKVLWKWESDNLPELPPNVVVKKWFPQVDILGHPNCVLFITHGGIHSVEEAVYYGVPMLAISIFGDQLYNSIMMESRGAAIRLKYSELTENRFGDNLHNMLSNASYKQNAIKLSKIFHDQPMKPLDKAVYWIEYVIRHNGAHHLKTAANQLNWIQFLSIDVMLVILTTIFLFLIITFYIMKKMCKWFMSYRQRHTETNDDKKKK

SEQ ID NO: 7294 - protein, 520 aa, Ceratitis capitata
MHLLTTILMASAILLGSQVQSYRILGILHTGARSHHIVGSALMKGLARRGHDVTVISPFPLKEPLKNYHDIETPIIKGIMESTAQHLLETIKKNVFVNVKGFHEMGLNMTRTFLQEPNVRKLLASNQTFDVVICEVFLSEALFGLSEHYNVPLIGLGTFGAHPWNTDLVGSPSPPSYVASAMLPFRDHMTLWQRVGNLAYNTFERLLLDLYYLPKQEAIYKEFFPNNKRDMYEVRRNTALVLLNQHVSLSFSRPYVHNQIEVGGMHINRKRSPLPADLEKFINESKHGVIYFSMGSNLRSKFLPLEKRQIILDTFRGLKQRVLWKFEDPQLEGKPDNVYISSWFPQDDILAHPKVKFFITHGGLLSTTESIYHGKPFVGIPIFGDQFLNMNRAEASGYGIRVDYTNLTRESFKSAIERMLSNDSYAKRVAEVSAIYRDQLMDPLDLAVHWVEYVVRHKGAKHLHCAGQDLSFIEYHSIDTMLILFGGVSTVILLLMLLIRAAWRWLQFALARKDIKQKKH

SEQ ID NO: 7295 - protein, 522 aa, Spodoptera exigua
MSSLLFITTCFTLVLAPCEAARILGVFPVPSISHQVVFRAITQELAQRGHELIIITPDPAFPKGKTPANLTEIDVHDVAYKMWRDDIQDIVIGEIHGILPEYAIIMKLMAKVLDVELKDRQVQKLLNDKSQKFDLILAEACVRSAVVFSHIYKAPVILISSFGPFLDNYNVMGAPTHPLLYANNISRRFNNLTMWDKIVKLYYRYNIEVMLNKNYAYENQMLRSHFGPDLPPIEEIYNNVAMFFLNLHPIFEGNYPVPPSVVHIGGIHQVPEKDLPKDLQNYLDSSKNGVIYVSFGTNVEPSTLPAKKLKVLVDVLSRVPYDVLIKWNKDVLPGIGANIKLSKWLPQTDLLRHPKVKVFITQGGLQSTDEAIAAGVPLIGLPMWGDQWYNTERYERLKIGLILDIKTLTEEIFENAINNVIEDESYRQNIRKLNTLIRDQPQPPLERAIWWTEHVLRHGGGSHLQGPAANMSWAEYLELELILVIVSILLLAITIFMIASYYIFLCAKNKFYSNQSFSIIRY

SEQ ID NO: 7296 - protein, 512 aa, Papilio xuthus
MILRLILLYLLCLQFIESARILGVFPTPSISHQVVFRVLTHELARRGHELTVITTDPVHPNEVPENLTQIDVHDLSYSRWNKVISEMEDGSRDVTKQVEAMMNLNFEIFEEQVKCKSVQKLLSYKHDHFDLIIVEAFLLFTLGFSHVFKAPVIWVSSFAGVWDNYEAIGAPSHPFLYPVSVRDKLNNITMWEKINQLRKEYKMRNLNRNNVAVNKLLKKLFGEDTPPIQKLFDNVAMLFLNVHPIWDSNRPVPPGVIYMGGLHQNPIRELPKDLKLYLDSSKNGVIYFSLGTNVKPSYVPPEKLQAIINVFSRLPYEVLWKWDNELLVRSNNIKISKWLPQSDILRHPKVKLFITQGGLQSTDEAITAGVPLVGIPLLADQWFNVDKYVQHKIGVRIDIDTLTEEMFENAIRTVINDTSYRENILRLRSIMQDQPQSPLERAVWWTEHVLRHRDARHLRSPAANISWTQYLELELVFTLASVLILSLVILFVVLKIIWNYITSVVTTKIKKS

SEQ ID NO: 7297 - protein, 437 aa, Pieris rapae
MKEKRLKFGDKAGMYKVTEDLATLLGMLIEEQLKTDGVQKLINDKSKKYDLIIIEACTRPAIMFSHLYKTPVIAISSFGMAFGGEDLVGAPSHPILYPNMLHQRLHNLTFWEKFNEFYKHYWIVNMWKSTENKEFRLIKKYFGGNDVPSYEELYKNVDMMFLNIHPMWSHNQPLPPNVISIWGIHKSPPKSLPQDLQAYLDSSKNGVIYISFGSNAPSSLLPPEKIKILINVFSKLPYNVLWKWETDVLPGKSKNIKIAKWLPQSDLLRHPNIKLFITQGGLQSTDEAMNAGVPLIGIPMLGDQWYNVELYEYHKIGVRIELETITEEQLTKAIKTVTNDKSYKENIIRLNRLMNDQSQSALDRAVWWTEYVLRHGGAKHLRAAGANISSFEYYEIEFLLKLVSLVFSIAAIILYLMYRVLRIIVPSNSPSSKSKTS

SEQ ID NO: 7298 - protein, 1066 aa, Trichoplusia ni
MGVLLHITSFYILFVYTIQAARILVVVPTPTISHQSVFRPLTQELAKRGHDVTVITTDPAFPKGGAPANLTEIDVHDTSHDASIKTSFAKSSLDLIQQFKLIPEMVLSIIEVQLKDENVANLIRDKNRQFDLLILEAYCRPLLLYSHIYKVPVIQMSSAGAFRNSLKQFGVPTHPLLYTHVPSQRLNNLTMWEKVKSLYFTYTLDKIMDDMVVKEDAFLRKHFGSDFPSVTELSNNVDMLFLNVFPIFEGIRPVPPNVVFTGGLHQNPVKELPEDLKSYLDSSKNGVVYLSFGSTMDPTLLPPERIQVLVKAASQLPYDVLWKWNGDELPGRTENIKISKWLPQSDLLRHPKIKLFITQGGLQSTDEAITAGVPMIGVPLLGDQWFNVERYEYFKIGVRLDLDIITEDNFKATVHKVIGDDSYRQNIVRLRGLLHDEMQTPLERAVWWTEYVLRHGGAKHLRSPAANISWWEYLELELVLTVLGGVLAISSVFILIAFKAYMYLFATYPGKKTSPGKKKRNPLTPLRLKTMSTEQFMTKLKKQFRVGIDMGILFYSLTLYILFVNTNEAARILVVVPTPAISHQSVFRPLTQELAKRGHDVTVITTHPAFPKGGAPANLTEIDVQDVSHDTWTKPFLEKPPTNMVDQMNLLSDMMVDTVEAQLKDEKVATLLNDKSRQFDLLILEAFCRPLLLYSHIYKVPVIQMSSAGAFHDSYVQFGAPTHPFLYPIVPSERTNNLTLWEKLKELYIIHIMNNFADDITVKGEKLLKRLFGEDSPTMKELSNNVDMLFLNVFSIFYGIRPVPPNFVYIGGLHQNPDKELPAELKSYLDSSKKGVVYLSFGSSVDPTLLPPERIQVLVKAASKLPYDVLWKWNGDELPGRTENIRISKWLPQSDLLKHPKIKLFITQGGLQSTDEAITAGVPMIGVPLMADQFFNVERYEYFKIGLRLDLNVITEENFISTVNKIIGDDSYRQNIVKLRGLLRDEVQTPLERAVWWTEYVLRHGGAKHLRSPAANISWAEYLELELVLTLLGGVLVILGALLLIVVKLYKCLFSRKVAPVKSKRN

SEQ ID NO: 7299 - protein, 535 aa, Sturnus vulgaris
MRVPLCTTYTMLLALLLPFLCLLSPAAAGKLLVIPMEGSHWLSMKKVLLELSKRGHEIVVVAPDNKILIDSADVYELKTYPVPFTKEDMEEHIRSVSARTFSQDPFLVRFSKLLEDYRKSGTMFHASCKSLLYNQELMKYIGDSHFDALLTDPVSPCGQIIALHFSIPSVFFLRMVPCALDVRAAQGPDPPSYVPRMFSENSDHMTFSERVRNFLIALSESFICNIAYSPFEELASEFLQKPMTMTELLSHGSVWLRRIDFVFEYPMPVMPNMVFIGGIHCGEKKKPLSQEFEAIVNASGEHGIVVFSLGSMVSEIPEKKAMEIAEALGTVPQTVLWRYTGKTPSNLPKNVKLVKWLPQNDLLAHPKTRAFITHGGSHGVYEGICNAVPMVLMPLFGDQMDNAKRVESRGAGLTLNILEMTSNDISNALKAVINDKKYKENIQRLSELHLDRPIHPLDLAVHWVEFVMRHKGAPHLRPAAHDLNWVQYHSLDVIAFLAAVTLLSLFISFKCCLCLCRRCFCKKGRTGKPAKAKSH

SEQ ID NO: 7300 - protein, 533 aa, Canis lupus familiaris
MAAGFLAPLPVLTGLLLILCDGRWVEGGRVLVVPMDGSHWLSMKKAVQKLHARGHQMVVVSPESNMHIKEEDFFTLTTYATPYTQEEFDNFMLGQSYLVFQRMSFLKTFLKTMEGLKTATLIFQRSCESLMHNKNLIRHLNASSFDVLLTDPVYPCGAILARYLSLPSVFFLRNIPCDLESESTQCPNPSSYIPRLLTRNSDHMTFLQRVKNMLYPLALKYFCHFSFTPYASLASELLQREVSLEDILSSGSVWLFRGDFVLDYPRPIMPNMFFIGGINCANRKPLSQEFEAYVNASGEHGIVVFSLGSMVSDIPEKKAMEIADALGKIPQTVLWRYTGTPPPNLSKNTILVKWLPQNDLLGHPKARAFITHSGSHGIYEGICNGVPMVMLPLFGDQMDNAKRMETRGAGVTLNVLEMTSADLANALKAVINDKSYKENIMHLSRLHKDRPIEPLDLAVFWVEFVMRHKGAPHLRPAAHDLTWYQYHSLDVIGFLLAVVLGVVFITYKCCAFGCRKCFGKKGRVKKPHKSKAH

SEQ ID NO: 7301 - protein, 289 aa, Danaus plexippus
MEREAKENILLEKLFGSDIPPLHELANNVNLLFLNVHPIWIDNQPVPPNVVFIGGIHKQPPEEIPTDLLYFLNASTNGFVYISFGTNVKPSLLPPEKIDIMIKVLSKLPYSVLWKWDKEGMPRQTNNIKYVPWVPQKDILMHPNIKLFVTQCGLQSTEEAINALVPLIGIPVLGDQFYNAEKYVYHGIGIKLDLDYLSEEVFSGALETILNSKSYRENLIRLRKIMNDQPESALQRAIWWIDYTLRHGGAKHLRARGANITWAQYLELELVFTVLSAVLITYLILGGFA

SEQ ID NO: 7302 - protein, 546 aa, Caenorhabditis brenneri
MNIKLLILTFCFLVFSNASKILIFNPIFGFSHVKFISKMADIIADHGHNVTLFQPYHNALKNLDGLVKNKNIEVKKFPCNIQIKNFFQILNYYPSHYSELLKAETQTFPIFWDSKLIGNPILGAFMLASVLGGEFKKTSMGRYIYITSIRKVLFAEVVSDQNLINDLKSRKFDVVMAETFELTGIYIQFSNGLFGQPSFLGHVPQPGSKGAPEAGFLDRLNDMYRFVFVHIGQERLNLYQNKFIEEAIGRPVPFWKDLVKQSPVYITNSNPYLDFAVPTTASIVHVGGITMDLEKMKNVGKLPEEYEKIVSERESTVLISFGSVIRSHEMPENFKAGIIKMFELLPDITFIWKYEKEDVEFQKRLPKNVHLKKWVPQPALLADERVKVFITHGGLGSTMEVAYTGKPAIMVPIFGDQNHNAMMLARHGGAVAYDKFDLKHGDQLANVITTMVSDPKYKNNAKMLLEVLRNQPIDPKMNFLNHLDFAIKFPNHRSQVPEINEVGWIAHYYLDVLVFLSISAVVFTYLLVKMLKRVFRRFLEKKTKTE

SEQ ID NO: 7303 - protein, 517 aa, Neodiprion lecontei
MKLGITFLFLVVACVADCSRILAIFSYPVQSHNMMFEPLMIGLARAGHSVDVISHFPPKKSVQGYNHISLKGTLHNLVNNITADYASIHGGVYQMMNFLCNREVKDLCGLLPLPQLQRVTNADTKYDVMITEILGSNCYLSVAHIMKIPFIGIVTNVVYPWVIDPVFGDANPSFIPSQLSTFTNEMSFFERVENMMIHVYSKFLFYYWDVTVSNPLARKYFHDLPPLNDIYNNISLVLANSHFSIHGVRPGTQAIVEVAGLHIDETQVLSEELERFLNSSKDGVVYFSMGTLVRSDTFQVEKILAIYESFSELTNYKVLWKGNLKDMPKPLPSNVKIVSWVPQYAILRHPKVKAFVTHGGAMGTQEAIHAGVPIIGIPFFFDQSSNVMGYVQRGFGVYLSYKDISKVSFSKALREVLSNPKYQSNAARYSRLFRDRPLSPMDEAIFWIEYVIRNGGEPLRSSGQHLNWFQYYLIDVGLFLLAITMLVIAVVFTFVKTVLHIIACKQSCELPVKDKFS

SEQ ID NO: 7304 - protein, 531 aa, Chinchilla lanigera
MATALQVPLRGLLGLLLMACVTPWAEGGKVLVVPMEGSHWLSMKDVVRQLHARGHQAVVLAPEVSWHIKEEDFFTVNFYAFPYTQEEYNHLFLDYTKMVFETQNYVESFLKTKVKKDSALLLSGCSHLVHNKELMASLAESSFDVVLTDPFLPCGAIVAQYLALPAVFFLNALPCGLHYEGTQCPNPVSYVPRSMSSNPDHMTFLQRVKNMLFVLTEKVTCNVVYSPYAQLASEVLQRDVTVQDLLTSASIWLLRTDFVNDFPKPVMPNMVFIGGVNCLHKNLLSKEFEAYVNASGEHGIVVFSLGSMVSEIPEKKAMAIAEGLGKIPQTVLWRYTGTPPSNLAKNTILVKWLPQNDLLGHPKTRAFITHAGSHGIYEGICNGVPMVMMPLFGDQMDNAKRMETRGAGVNLNVLEMTADDLEDALKKVIYDKSYKENIMRLSSLHKDRPIEPLDLAVFWVEFVMRHKGAPHLRPAAHDLTWYQYHSLDVIGFLLAIVLFVAFVAFKCCAYGFRKCFGKKGRGKKAHKSKTH

SEQ ID NO: 7305 - protein, 522 aa, Trichoplusia ni
MEALKCVLFFLTVANWCESANILYVVPFTSKSHYIMLKPIGLELARRGHNVTVITGHRDPNPPPNYRQVMVDEKEIWDVIGGRPNVFDMAQTSTEEFHYNILWKGGLAFMEVVLDSKEVKAFLAEDNKFDLVINEQFYQESLNVLAHKYNAPLALVTTFGNCMRHNILVRNPLQLSTVISEFLPLEDPTSFYGRLRNLYFTVYEYIYWRYWYMNEQERFVKKYIKGLPEPVPSLYDLQRNASLMLMNSHFSFDTPAAYLPNVVEIGGSHLIRSNTTLPADLQKVLDNAKNGAVYLNFGSNVRSAEMPEDKKNAIINVFRKLKHTVLWKWEDDHFKNKPDNLIIRKWMPQKEILAHPNVKVFISHGGLIGTQEATYNGVPLIGIPIYGDQFNNLLQAQSFGYAKILQYNDINEENLYKLLHEVLTNDSYAKNAKEMSRRFQDRPMSPLDTAMYWIEYVIRNNGAHYWKNPALELSWIAAYMIDVYLFIFGVTLLFLYVVAKVVSIVLSAFSGKKTKKQKTKRS

SEQ ID NO: 7306 - protein, 533 aa, Cavia porcellus
MATASRIPHLLILGLLLCALRPLVTHAGKLLVVPVEGSHWLSMVGALQQLQQNGHEIVVLAPDALLYIKEDSPFTLKRYPVPFSKEDLETNFALLGHFVFENDPFLIRVIKMYKKIKKDSAMLFSGCSHLLHNKELMASLVESSFDVVLTDPFLPCGAIVAQYLVVPAVFFLYALPCGMHFEATLCPNPMSYVPRSMSLNPDHMTFLQRVKNALITLTEKVACNFVYSAYAPLASEVLQRDVTVHDLISSASFWLFRNDFVFDYPKPVMPNTAFIGGINCLHKNLLSQEFEAYVNASGEHGVVVFSLGSMVSEIPEKKAMAIAEGLGKIPQTVLWRYTGTPPSNLAKNTILVKWLPQNDLLGHPKTRAFITHAGSHGVYEGICNGVPMVMMPLFGDQMDNAKRMETRGAGVTLNVLEMTSDDIADALKKVIYDKSYKDNIMRLSSLHKDRPIEPLDLAVFWVEFVMRHKGAPHLRPAAHDLTWYQYHSLDVIGFLLGIVLLVAFISFKCCAYGFRKCFGKKEQRKKTQKSKTH

SEQ ID NO: 7307 - protein, 507 aa, Drosophila busckii
KMQPQRLLFSCLTLWSLWSAAWTARILLVFPYDFPSQCMLLTPYIRALVERGHELTLIHAFNNCDVVHEVHAIYAKDRQFKINDWFEHEVTPSISKFGQLASLLKYLVKMHLNVLEDPQVQQLMRSGVSYDLFIIEPSYTDALFGLAAHFNATAMGLATCGADWNMDGLVGYKSSSALETISSSISFKPDAGLLDQLYNWMQISEEWLLQQLIFLPQLRSVHTHFFGHLAQSFEQNRQSFSLILLNQHFSLFESRANVPGMVEVGGMHVPKQLPALAPQLARFIAEAEHGVVYISLGNELQSKDLSAKTLQVLLHTFESLPQRVIWRFETEATPNASSNIYFGQWLPQQAILAHPNLRLFINHGGMLSIIEAAHYGKPMLGLPLFFDQARNVERLVLEGTALSLDINALTKHSFDHALRQLLCQPQYRLRAQALSQRVRDVPLHPLDSAIYWTEYVLRYKGAAHMRVSSANIKLTDYYCLDHLLIIFVRFGLIFLLVVYILFKLKSY

SEQ ID NO: 7308 - protein, 518 aa, Trichoplusia ni
MGLLCLLTSLILIVNTNEAARILGVFPTPSISHQVVFRPLIQELAKRGHDVTVITTDPAFPKGGAPANLTEIDVHDISYNIYQEIINDIPRGNKNDVIHQMEESLPFLTKIVDKQLNDEAVRRLIEDKNKKFDLLILEAWVRPALGFSYLYDAPVILMSSLGAMFDNSATVGAPTHPILYPSIFRQKLKNLSMWEKIWELYTHYKILDIHYQNRHFEDQILKKNFGPDIPSVLELNNKVDMLFLNVYPVFEGIRPVPPNVIYTGGLHQNQEKELPKDLKSYLDSSKNGVIYISFGTNVDPTQLPPERIQVLVKAFSQLPYDVLWKWNGDELPGRTENIRISKWLPQSDLLKHPKIKVFVTQGGLQSTDEAITAGVPLIGVPMLGDQWYNVEKYEYHKIGVRLDLDDITVENFKNTLLKVMGDESYRQNIIKLRGLMRDEVQTPLERAVWWTEYVLRHGGAKHLRSPAANISWWEYLELELVLTLLAGLVIIVTALVLILFALYKHFLKYAASIKVKRA

SEQ ID NO: 7309 - protein, 530 aa, Myotis davidii
MAPAVLTGLLPLCVCLLLAPGFAQAGKLLVIPMDGSHWFTMRSVVEKLSHRGHEVVVVRPEVSWHLGQSSNYTVKTYSTSYTLEDLNDQFRTFADSQWKTRPQYLHSMLMSSSNSVFEYFFSNCRSLFNDKKLVKYIEDSSFDAVFLDPFDMCGFIVAKYFSLPSVVFTRGLFCHYLEEGAQVPNPLSYVPRGLFSLSDTMTFRQRVWNHIIHLEEHLFCDYFLKTALEVASEILQTTVTAYDLVSQPSIWLLRNDFVLDYPRPVMPNMIFIGGINCHPGKPLSQEFEAYVNASGEHGIVVFSLGSMVSDIPEKKAMEIADALGKIPQTVLWRYTGARPSNLAKNTILVNWLPQNDLLGHPKTRAFITHSGSHGIYEGICNGVPMVMMPLFGDQMDNAKRMETRGAGVSLNVLEMTSEDLENALKTVINDKSYKENIMRLSSLHKDRPIEPLDLAVFWVEFVMRHKGAPHLRPAAHLLTWYQYHSLDVIGFLLAIVLGVAFVVYKCCAFGYRKCFGKKRRVKKSNKSKAH

SEQ ID NO: 7310 - protein, 523 aa, Linepithema humile
MRILLLIFPLLLYSSICHGYRFLALFPYNGHSHFVMFEQLLKGLARKGHQIDVVSHFPLKKPYSNYTDIVTLTATVTVKDSLTYEFLKNTLVGINPVSIIAETFGNDLCEFLAHPKIQELVRNPPKDPPYDAVIMEIFGAQCFAVIPHLLNVPAIAVSTTVLYPWLHKIIAQPYNVAFVPNNCITGIPNSMNFWHRLYNSVNTLYSNLLFNYLTRKQDEILRQHFGPDIPSVRELEAKIALILINSHIAVNTIQPQTPAAVDVGGLHVIDDVTLTLSPTLEKWMNESKDGFIYFTFGSMAIIETFPPEFLNILYSSLSKIAPIRVLIKVSNPDKLPPGLPKNIYTSPWMPQIKVLKHPNIKGFITHGGLMSTQEAIILGVPMIGIPLFADQFLNIDIYVKKNIAVKLDLYTMTEKDVDEALNAILWNPIYSESVRNLSQRFLDRPLNALDTAIYWSEYVIKYGSDALRSPAMDLYWWQLYLLDVIVFLLLCAIIVVIVIRFFVRLLLQMINDKRKSLHTKKTN

SEQ ID NO: 7311 - protein, 832 aa, Papilio machaon
MFPTPSISHQVVFRPLTQELAKRGHEVIVITPDPAYPKGQAPKNLTEIDVHDISYSKWKIMMGRIKDVARDIIAQLEVIINSNNAVFEEQMQTESVQEILKYKDDYFDLILVEACVRPAIGLSYVFKAPIIQVSSFGAIMDNHYIMGTPTHPLLYPSMSRDRLYNLTMWEKFKQLRKEFITDMYTNNFEYDNDILKRVFGENVPRIYELYDNVAMLFLNFHRIWDSNRPVPPGVIYMGGLHQNPQKELPKRSRTATPAESEGSASPAPAPSSLLQDVVDIKTLLLQLKRVLQEGRNGLGNIYVWASGDGGEDDDCNCDGYAASMWTVSINSAINDGQNAHYDESCSSTLASTFSNGARDPSTGVATTDLYGKCTATHSGTSAAAPEAAGVFALALHANPSLTWRDIQHLTVLTSKRNSLYDAKSTDEAITAGVPLIGIPMLADQWYNVEKYVHHKIGLMVNIDTLNEEKFESAIKSILTDNSYRENILRLRSIMQDQPQRPLERAVWWTEHVLRHGGARHLRSPAANISWAQYLELELVFTLATILILFLFLNEIHENVVMKRLFGEETPMIHELFEKVEMLLLNVHEIWDNNRPVPPNVIYLGGLHQNVKKDLPKDLQTYLDTSANGVIYVSFGTNVRPSLLPMRKIKILTEVFSELPYEVIFKWDKDELPGQTSNIRIMKWLPQADLLRHPNIRLFITQGGLQSTDEAITAGVPLLGIPMLGDQFYNVEKYEKLKIGRGLNMDTLSKETLAAAINTVIEDESYRRNIQHLRTVMNDQPMKSLDRALWWIEHVLRHGGAGHLKSAGAHVSWSEFIELDVIIVLTLFLLFYN

SEQ ID NO: 7312 - protein, 426 aa, Vanessa tameamea
MILKTSIFILTYLFTVTQSAKILGIFPIPSISHQVVFRKLTQELVKRGHEVTVITTDPAYPKGKAPANLTEIDTHDISYTIWRQVLQDNFKFEQKSVPKFTEFRQANQFFSYIFLGQLNSPEVKELVSNKNNKFDVVLIEAVVRPALVYSHIFKAPTILVSSFGAIFNNHDVMGSPTHPILYPSTLQQKIYNLTFWEKLHNLYIHFTFEYANYLGEADEHAMFKKHFGPDVPPLSKLYENVHMLFLNIHPIWADNQPVPPGVVYMGGIHQSPEKELPKDIQSYLDSSEHGVIYVSFGTNVLSGMMPEEIVKIIANVLSKLPYNVLWKWDKDELPVKSKNIRISKWFPQSDLLRHPKIKLFVTQAGLQSTDEAITAGVPLVALPMLGDQWYNAEKYEKHGIGINLQTGTLTEDKLKNAIETVINDER

SEQ ID NO: 7313 - protein, 244 aa, Drosophila busckii
MQTFLDNAEHGVVYFSLGSYMKSTDMPPEKTAQLLQAFGKLKQQVLWKYENDSMQLPPNVMISKWMPQNDILAHPNVKVFMTHGGIFGTQEGIHWGVPMLCMPLYGDQHRNTIRSVRGGYARALVFSKLSVDSLVQNIEALIYEPQYKRNALEISQRFRDNAQHPLDEASFWIEYVIRNRGAPYLKSKGAFMPLYQYLLLDVLGCLLLGLFLGVWLPWRLLRRVHKWWAAGAAAAQAEKVKKRL

SEQ ID NO: 7314 - protein, 506 aa, Spodoptera litura
MKFNNIIILFCALFSQVLSLNILGVFPYQGKSHFFVFGPYLKELARRGHNITVISYFPLKEPIDNYHDIKLSGKVLEDVFPIYRSYWTIIETSLFLKNSGQENCITLLENENVQRLWKTEQKFDVMLMELFNNDCALGLAHKLGAPVVGLTSHVLMPWHYEDYGIQYNPSYVPVLFLEGGTKPTLYQRIERSIFHVYLVYLHKLTCRRNNQKTLAQYFDDVPPLGDLAKNVKMLLLYTNYVVSGSGLYPPNVREVGGYHVTKPKELPQDLKKFIEESEHGVVYISFGSMLRSTSTPKDKLDAIIAAVSEIPQRIIWKWEEKTLPGNPKNIFISNWLPQNDILAHPKVLAFYSHCGMLGTTEAIHYGVPMIGMPIFGDQPGNAAAIEESGLGVQIHIKDLTKELLLEKLRTVLNPEFRRKVKELSKIWHDRPQSAMDTAIYWTEYAARTANYTFRSPASSVPLYQYRIWDVTAVILAILIIFIYSIKTVISLVQKRREDRYYEFKTK

SEQ ID NO: 7315 - protein, 535 aa, Drosophila ananassae
MRISSSGAGIGLFFVVGLVLVLSSNADDKVKSSRILAVFPFPGRSQYIFAEQYLKELSRRSHNVTVINTFGSDKIEPNFRVIGAKKIHELMAAFNSIMYNAPASQWKMLTMTTEFINLLTTCILDDPAVKELLASDERFDMVVFETVQNEALFGLAQHFGALTMGISSYGTDRHIDELMGNISPLSYNPMLLSSRTERMNFEDRFWNLWDALLLWVHKRVVHLPTQRDLLKKYFPESKQSLEEIMDKFSLVLMGQHFSLSYPRPYLPNMIEVGGLHLQQQRKVQPLPQELSDFVGQATEGVIYFSMGSNIKSKDLPPSVRQALMETFASLPQSILWKFEDDQLEEKPANVFISKWFPQPDILAHPNVKLFITHGGLLSTIESIYFGKPVLGLPVFYDQHLNIQRAKQAGYGLSADLWSSNATVLIPLIQELLVNPSYAKAAETKSRLFRDQKETALERAIWWTEYVLRNDGAAHMRCASPDLSFVQFHGLDTWGLLLALALLVLLSFAIVLKLLFRGLCYVIVKRRHRTNKLKTH

SEQ ID NO: 7316 - protein, 516 aa, Galleria mellonella
MGYQANMKSMVCMLLLCMAAAKVSSYHILGGFAIPSRSHNHLGKGVVDSLLKAGHQVTWITPYPFENKNKNLKLIPVATQVIGESLNMMNPEVANRGISLIKECALNVTSVTINTPAVREAIVNTKFDAVVTEWFFTDTDVGYAAVQQVPWIVLVGTVYNSILEEMVDEVRSVPTVPIFLNNATIPMNFWQRLLNTGLHSLITLYNWWDRLSATERYNAYFSPLAAARGVPLRPFSEAANDLSILLVNGHPSFAPAQPVPPNVINVAGYHIPEDTPPLPKDLQDLLDSSKHGVVYFSMGSVLKSAALPEHIRRGLIQVLGELPYTVLWKFEEEISGLPKNVHVRPWMPQPSILAHPNVKLFITHGGLLSSLESLQYGVPLLAIPMFGDQRNNAQTAYQNGYARQVVFGDDVADQLRVELKEMLNNDKYYKRAKYLSRLFRNRPVPPSKLVSHYVELAIETKGAHHLRSPSRQYAWYARWMLDQAALLLVALYLVYRLARALLSLCCGKYKQKIKTH

SEQ ID NO: 7317 - protein, 523 aa, Orussus abietinus
MKSLLLLGVLFLAQSEGARFLGLFPLQGKSHFIMMEQLMKELARRGDQVDVVSHFPQKTPFPNYKDIDVSGTVPIVVNNMSISYVDTFNTLSVKKLVHMAGTQVCQLLGHPKLQEIIKNPPKDPPYDAVIVEVFASHCYFAFGRLLNVPVIGVTSSGLYDWMNEPMGNPSNPAYIPGGFTGFPAKMTFIQRLSNTLISLFINFDFQWWINEQSELIEKYFGPDMPKVEVLQKELTLLLVNSHFSLNGVRPLTSAIVEVGGLHVKSGGVLPQELQKWLDDSKHGVVYFSFGSMMKIESLPEKTLLAFYETFRKIAPVRVLMKIPKVDELPKGLPENVKTMQWIPQVEVLEHKNVKVFITHGGNMGTLEALRFGVPLIGFPLFGDQHANIQNFVNRNIAIALDYKKVDEKQLTEAITTILKDPSYKKNAENLSRKYLDRPLSAMDTAIFWIKFVLRNGNVLRSPSLDLTWWQVNLLDVYGVLLGGLLLTLYILQLVLRGLWRLLKGSSRGSSGKSATSSRSKKTN

SEQ ID NO: 7318 - protein, 530 aa, Rattus norvegicus
MAPSGCPSSLPLCVCLFLASGFAQAGRLLVVPMDGSHWFTRQMTVEKLLQRGHEVGVVIPEESWQLGKLVNCTVKTYSIPYTVEDMDREFKHFSYTQWKTPEQSMYSLITGSVKDFLEITFSHCRSLFKDKKLVEYLKQSSFDAVFLDPFHVCGLTVAKYLSLPSIIFAKDIFCDNLKEGAQCPSLPSYVPRLFSKSADTMSFKERLWNHLIYFEERAFCSYYLKTAIEIASEVLQTPVTLTDLYSPVSIWLLRTDFVFNFPRPVMPNMVFVGGINCFQRKPLSKEFEAYVNASGEHGIVVFSLGSMVSEIPEKKAMEIAEALGRIPQTVLWRYTGTRPSNLAKNTILVKWLPQNDLLGHPKARAFITHSGSHGIYEGICNGVPMVMMPLFGDQMDNAKRMETRGAGVTLNVLEMTADDLENALKTVINNKSYKENIMRLSSLHKDRPIEPLDLAVFWVEYVMRHKGAPHLRPAAHDLTWYQYHSLDVIGFLLAIVLTVVFIVYKSCAYGCRKCFGGKGRVKKSHKSKTH

SEQ ID NO: 7319 - protein, 520 aa, Atta cephalotes
MRILLVIFHLLFCLSICHGYRLLGIFPFHGKSHFVMIEQLMKGLARKGHQVDIISKFPLKKPYPNYTDIVILPTDVHLVNNVTYETMQQLITSNPINAVSTWAGNELCKFLGNPEIKELSKSKDPPYDAVFIEIFGAQCYSVIAYMLKVPLIGISTTSLYPWLYDMIAQPESLAFVPNNVINLAEPMNFWQRLYNVVHTFYDKWYFNYLTTQEQDRIIRKHFGPNIPSVRELEKKMSLVLINSHIALNGIQPRTAAAVDVGGIHVQDENETLQPELEKWMNDSKDGFIYFTFGSMVMIETFPYEFLRALYASLGKIAPMRVIMKIPKPEKLPAGLPENIYISPWMPQIKILKHPNIKAFITHGGLMGTLEAIICGVPMIGIPLFADQFSNIDRYVAKNIALRLDVNTITEKSFDAALNAILRDPLYRENARKLSQRFFDQPLNAVDTANYWVEYVIKYGENCLRSPALNLTWWQLSLLDVIGFLLFCITIIVTIVIFIVRFVKEMLNGNYNSLSYSKKIN

SEQ ID NO: 7320 - protein, 530 aa, Chinchilla lanigera
MAPARSPAPLPLCLCLLLASGFAQAGRLLVVPMDGSHWFTMQSVVEKLVQRGHEVVVVTPEVSWQLGQSLNLTVKTYSTSYTLEDLDRNFKDFAEAQWKNAEKSILFALRDLPVGFFDLLFSHCRSLFKDKKLVQYLQESSFDAVFLDPFDACGLIVAKYFSLPSIVFSRGIFCHYLEEGAQSPAPLSYVPRVLLGFSDAMSFRQRVWNHIFHFGEHLLCPYVYKKALEMASEILQTPVTAYDLFSHTSIWLLRGDFVLDYPKPVMPNMVFIGGINCHEGRPLPQEFEAYVNASGEHGIVVFSLGSMVSEIPEKKAMAIAEGLGKIPQTVLWRYTGTPPSNLAKNTILVKWLPQNDLLGHPKTRAFITHAGSHGIYEGICNGVPMVMMPLFGDQMDNAKRMETRGAGVNLNVLEMTADDLEDALKKVIYDKSYKENIMRLSSLHKDRPIEPLDLAVFWVEFVMRHKGAPHLRPAAHDLTWYQYHSLDVIGFLLAIVLFVAFVAFKCCAYGFRKCFGKKGRGKKAHKSKTH

SEQ ID NO: 7321 - protein, 539 aa, Culex quinquefasciatus
MQHFTSLLLTTLLLAFVPLATSSKILVLVPFPAPSHWLWLEHFVQELLERGHQVTAISNFAAKERHPNYTEILIDPPFDIPYYFPVSDIFEAKYTSDLSNLLLYWNVGLTTTKFALENPNVQQFIEQDDSVFDLVISEQFYQEAFLMFAHKYRAPIVTIGTLGYSDFMDRAMGLLTPWSFVPHPILLYMDDMTFSQRCYNFLVSAVDALIRKYYYMPRQDKLAQKYFSAIEGPESFPSVYELEKSISVMLINSHVSTSPPRPSISGLVNVAGAHIQPAKPLPADIQRFLDGATEGAIFFSLGSYVQSSDMPKDKLKAFFEVFRNLKQKVLWKFEDESMTNVPRNVMVRKWLPQSDILAHPKVVLFITHGGMFGSQEGIFRGVPMLFIPFYGDQHRNALRAERAGYALTLNFADVNAITLGSRINELLTNPAFNRLAKKASELFRDNLVPPMDEAMHWIEYVIRHKGAKHLKSISVDFNWVQYLMLDVLTFFVIAILLTSFLVYHIIGAFLEKPTKHKSKDHKRPTVPPKVRTVKKVKAN

SEQ ID NO: 7322 - protein, 523 aa, Microcebus murinus
MAGRWVLLLVGSLLPGILLSEAAEILTMSTLGGSHYLLMGRVAEILQDHGHHVTMLRQGGNSLISDFKEEEKSYQVISWFPPEDYQKEFEKVSSLFVEEGYNERKMFQNYLKLVEQLGFQCSHLLNRRDIMDSLKNKNFDLVIVESFDYCHFLIAEKLGKPFVSILPTTFGTVHFGLPNSLSYVPVFHSSLTDHMDFWGRVKNFLTFFTFSRRQWQVQSMYDNIIKEHFPEGSRPVLSQLLLKAELWFVNSDFAFDFARPLLPNTVYVGGLMAKPTKPVPQDLENFIARFGDSGFVLVAMGSVVNMNTLQEVLKEMNSAFAHLRQGVIWKCKHSHWPKDVNVSTNVKLMDWLPQSDLLAHPSIRLFVTHGGQNSIMEAIRHGVPMVGIPVFGDQLENMVRVEAKNLGVSINLKELKAETLTLKMEQVMEDKRYKSAAVAASVIRRSHPLTPAQRLVGWIDHILQTGGAAHLKPYAFQQPWHEQYLLDVLLFLLGLTLGAVWLCGKLLRVVSRWLCGARKLKET

SEQ ID NO: 7323 - protein, 519 aa, Merops nubicus
LVLSLSFWSLAEGGKLLVVPQDGSHWLSMRVVLERLWEKGHEIVAVVPEATLLMKSSESFTIKTYSVPYTQEFLDGFYHSIGQSTFQNPPFLEKITGLVKNVSEATEMFSSACRHLLYNEELMKYLQDSKFDAIMMDPVLPCGPIIAEYLSLPSVYFMRGLPCALDYEAARCPSPFSYVPRTFTSSSDHMAFMERVKNLLVGFSGHLICYLFYFRYENLASEFLHREVTMLELFSQASVWLMRYDFVFEYPRPVMPNMVYIGGINCEQKKPLSKEFEAMVNASGEHGIVVFSLGSMVSEIPMKKATEIVKALGSVPQTVFWRYTGEAPPNLPKNVKLVKWLPQKDLLAHPKARAFITHGGSHGVYEGICNAVPMLLMPLFGDQMDNAKRVESRGAGLTLNILEMTSEDISTALKAVINDKKYKENIKRLSDLHLDRPIHPLDLAVHWVEFVMRHKGAPHLRPAAHDLNWIQYHSLDVIAFLLAVLLLSLFISIKCCLCCCRRCCCKKGRTRKATKAKSH

SEQ ID NO: 7324 - protein, 207 aa, Eumeta japonica
MDNAKDGVIYFSMGSNLKSKHMPATMKREFLEIFAQLKQTVIWKFEETLPEVPKNVHMLKWAPQQSILAHPNCVLFITHGGLLSSTETVHFGVPIFGIPVFGDQFVNVGRSVNKGIAVKVDLSYNTPKELKKGNPRSTQQSKLSGNSEVFLAGIPRPAGAPGRGAGALGGARDQDARRAAPALARAQHALVPEDVPRPSGTCLHCII

SEQ ID NO: 7325 - protein, 855 aa, Fukomys damarensis
MATALPVPLRGLVGLLLLVCVTPWAECGKVLVVPMEGSHWLSMKDVVRKLHARGHQAVVLAPDVTLHVKGEDFFNLKTYTSHYTEEEFHHLILSHTKLIFETQHYLKTFLETTAIVKKGSAIYERSCVEMLHDSSLISQLNSSSFDVIITDPMIPCGAVLAKYLRIPAVYFLRAIPCGFDFEGTQCPNPSSYIPQLLTTYSDHMTFLQRVKNMLYPLALNHICHISFAPYARIASELFQRDVSLVDILSHASVWLFRGDFVFDYPRPIMPNMVFIGGINCIRRKPLSQTGGFNHVTRSNINLVCALALAIWEQGKESKGKGAMAMASQGPHPLVLGLLLCVLRPPVSHAGKLLVVPIDGSHWLSMVGVIQKLQQNGHEVVVLAPDALLHVKEGSSYTLKRYPVPFQREDVEASFVELGHDVFANYPFLQRVIRMYKKIKKDSALIFSGCSHLVHNKELMASLGESSFDAVLTDPFLPCGAIVAQYLAVPSVFFLNALPCGLHYGATQCPNPLSYVPSSMSLNSDHMTFLQRVKNVLIALAQKVLCDVVYPPYALLAAEVLQRDVTVQDLLASASVWLLRTDFVFEYPRPTMPNLVFIGGINCLHKNLLSQEFEAYINASGEHGIVVFSLGSMVSEIPEKKAMAIAEGLGQIPQTVLWRYTGTPPSNLAKNTILVKWLPQNDLLGHPKTRAFITHSGSHGIYEGICNGVPMVMMPLFGDQMDNAKRMETRGAGVTLNVLEMTSDDLGNALKKVIYEKSYKENIMRLSSLHKDRPIEPLDLAVFWVEFVMRHKGAPHLRPAAHDLTWYQYHSLDVIGFLLAIVLLVAFVAFKCCAYGFRKCFGKKGRVKKTQKSKTH

SEQ ID NO: 7326 - protein, 520 aa, Solenopsis invicta
MRVLSLIFLWLLYLSICDGYRLLGLFPFQSKSHFAMAEQLIKGLARKGHQIDVVSSFPLKKPYPNYTDIVTVPITIELVNKISYEIMKRSFSVNPTYAIGTGAGNDLCKLLENPKIKELAQPKNPPYDAVIMEVFAAQCFGIIAHLLKIPMIGIVPIGMLHPWLPHIIGQPENLAFVSNDNLTAPLSFGKRLCNVLCTLHNKWYFDYLTTQVQDRLIRKNFGPDMPSVRELERKLSLILINSHITLHGIQPRTPAVVDVGGLHVQTENETLQPELKKWMDDSKNGFIYFTFGSMMMIETFPREFLKVLYASLGKIAPVRVLMKIPFPEKLPPGLPKNIYISSWLPQIMILKHSNVKLFITHGGLMSMQEAISCGVPMIGIPLFLDQFNNINACVAKNIAIRLDVDTITEKSMDAALNAILKDPLYRENARNLSQRFLDRPMNAINTATYWIEYVIRYGENSLRSPAVDMTWWQLSLVDVFGFLLLCATIVIIVVVFIAQFMLKLIHKDTTTLYSRKLKTN

SEQ ID NO: 7327 - protein, 389 aa, Diuraphis noxia
MRWLPWSLQSVVTLAAALACATDAARILAVETMAGVSHWNFMSGVLRALVDSGHTITAFTPFPTADGDRPRDNYTEVDLSRELLVARDNQLADIVQKWRTPVGQALQWARRSRYVCDMVYGHPAMRDLLRLHRRDGRPPFDVVIVEPFLSDCVSYVAGQLGVPLIFASALPAIGLMERLHTGHVPNPATASHLVAGHGVPKTFAQRLTNSALFAYNDVAIEYAERVLKCTDPKEYDTAPTVTTSLMFINGHYVSEPPNPVLPSIIHVGGIHLRPPKELPEDILEFIEQSSHGVIYFTFGSTVKMSSIPEHIRNAFIDVLAQIPQRVLWKYEDELENKPKNVMMKKWLPQRDILMHPKVKLFISHGGISGLYEAVDAGVPVLGFPLFGDQ

SEQ ID NO: 7328 - protein, 533 aa, Sus scrofa
MTAGSRGLRPLILGLLLCALGPTVSWGGKLLVIPVEGSHWLSMVGVIQQLQQKGHDTVVVAPDATMYIKEGAFYTLKTYPVPFRKEDLREAFVSLGHTIFENDPFLQRMLKIYKKVKKDSALLLSACSHLLHNKELMASLAASGFDAVFTDPFLPCGPIVAQYLGLPAVFFLNGLPCQLDFQGTQCPNPLSYVPRPLSGNSDHMTFLERVKNMLVALSEGFLCSAVYSPYAPLASEVLQRDVTVQDLMSSASVWLIRNDFVNNYPRPIMPNTVFIGGINCASKTPLSQEFEAYVNASGEHGIVVFSLGSMVSEIPEQKAMEIADALGKIPQTVLWRYTGPAPPNLAKNTKLVKWLPQNDLLGHPKARAFITHSGSHGIYEGICNGVPMVMMPLFGDQMDNAKRMETRGAGVTLNVLEMTSKDLENALNTVIKDKSYKENIMRLSSLHKDRPIEPLDLAVFWVEFVMRHKGAPHLRPAAHDLTWYQYHSLDVIGFLLAVGLTVVFIAFKCCVFAYRKCFGKKGRVKKSHKSKTH

SEQ ID NO: 7329 - protein, 471 aa, Tribolium castaneum
MPTPSYSHQIVFNPLWLTLNSRGHHVTLFTTDPIKNANLSNFRQIDWSFAYQLWHEKHNVSDIIRNFNTNLLKCLNQYVEMMNDIIIQELEHPQVQEIINDKNEHFDLVVVEFLNPAMVAFSKRFNCPFIGMSPMDLTNFVHEALGNPISPALFPDFISRYDGEMNFFERVLNTFYYVGSKLYFKYYFYPKIDEIIKEYFGEDVPPLEQMQRNASMVFLNTNPIIHNIRPLMSNVLMVGGGTHFEGDTPLPEDIQKFLDGAENGAIYFSLGTNVKSKDLDQDTKTTFLQVFSELPYKVLWKFEDAKHPKIKLFITQGGLQSLEEAIYNGIPIIGMPVYVDQYSNVKRAIRKGMGIILDSNNVGKEILKKSIEDILNNEKYKKSAEKLSILLKEQPVSGLNQTVKWIEYVLKYKGAKFLKPAQIPTYQYLLIDVLTFFVALFIFSAYFSFVCLKLLVKCMKERRRVKTTKLE

SEQ ID NO: 7330 - protein, 534 aa, Ornithorhynchus anatinus
MMAAGFHSTHSIFLVLLLCMSCWRSAEGGKLLVVPLDGSHWLSLRTVLLEVQQKGHEALVVAPEATVHIKPGDFYILRTYPVPFSKEELQNHFGTSGHELFEKRPFLERIFRTYKKVKKTSTLLFSTCTQLLYNKELMKYLEDNKFDAVLTDPFLPCGSIVAAYLKLPALYFLRGMPCSLDFDSTKCPNPSSYIPRAFSGNSDRMNFPQRVKNVLLTWSQLFFCSFVYSPYAQLASEVLQRDMTIVDVLSYGSVWLMRSDFVMDYPRPIMPNMVLIGGINCAHRKPLSQEFQDYVNDSGEHGIVVFSLGSMVSEIPVKKAMEIAEALGRIPQTVLWRYTGKPPANLAKNTKLVKWLPQNDLLAHPKTRAFITHAGSHGIYEGICNGVPMVLLPLFGDQMDNAKRVESRGAGVILNVLEMTSEDLSNALKTVITDKSYKENIMRLSALHKDRPVEPLDLAVHWVEFVMKHKGAPHLRPAAHDLNWFQYHCLDVIGFFLVITLSVFFIFFKSCMFCFRKCFPKKEKAKKSQKNKSH

SEQ ID NO: 7331 - protein, 533 aa, Fukomys damarensis
MATALPVPLRGLVGLLLLVCVTPWAECGKVLVVPMEGSHWLSMKDVVRKLHARGHQAVVLAPDVTLHVKGEDFFNLKTYTSHYTEEEFHHLILSHTKLIFETQHYLKTFLETTAIVKKGSAIYERSCVEMLHDSSLISQLNSSSFDVIITDPMIPCGAVLAKYLRIPAVYFLRAIPCGFDFEGTQCPNPSSYIPQLLTTYSDHMTFLQRVKNMLYPLALNHICHISFAPYARIASELFQRDVSLVDILSHASVWLFRGDFVFDYPRPIMPNMVFIGGINCIRRKPLSQEFEAYINASGEHGIVVFSLGSMVSEIPEKKAMAIAEGLGQIPQTVLWRYTGTPPSNLAKNTILVKWLPQNDLLGHPKTRAFITHSGSHGIYEGICNGVPMVMMPLFGDQMDNAKRMETRGAGVTLNVLEMTSDDLGNALKKVIYEKSYKENIMRLSSLHKDRPIEPLDLAVFWVEFVMRHKGAPHLRPAAHDLTWYQYHSLDVIGFLLAIVLLVAFVAFKCCAYGFRKCFGKKGRVKKTQKSKTH

SEQ ID NO: 7332 - protein, 521 aa, Amyelois transitella
MAELLFFIISVFILSVDSARILAVFPMPSISHQVVFRPLVLELVKRGHDVVLITPDPSFPEGGGPINLTEIDMHDIAYKPWIEYLPEKYKDKLMSIHTLSIKSTLEITALINTKVVEVQLLSELVQELINDKTQHFDLLLVEACLRPTLVFSHIFKAPLIQVSSAGPIPYNLQTVGAPMHPILYPFAYSKKLSNLTLYDKYMELYNFLINQYVTYGNERIENDMLRRTVGPDVPTVSELTENVDMLFLNVHSLWESNRPVPPNVLYLGALHIKQEKELPKDLKSYLDSSKNGVIYMSFGTNVDPSMIPPQVISSFVDVFAELRYNVLWKWHTEDVPRLPKNVKISKWLPQRDLLMHPNVKLFITQGGLQSTDEAIEAAVPLIGIPMLGDQWYNVEKYVHHGIGVRLDIDTIDADKFKDAIDTVINDKSYHDNIRKLKSLMYDQPQTPLEKAVWWTEYVLRHGGRHLRSPAANLPWTVYYEIELLFYLLLFVIGARFLLVYLLFKLYKFVRGWLSKRKLKTN

SEQ ID NO: 7333 - protein, 515 aa, Helicoverpa armigera
MYKQIITMLLLVLFLSVLDGARILCVFPVPSYSHHAVFEAYTNALASRGHTIVRITPFPTKKNDSSNVTDVDVSLSKDYFKSLVDRSRLFKKRGVISETSSVTARNYISLVHMLIDQFSMESVRQLIESNNVFDLLVTEAFLDYPLVFSHLFGDVPVIQISSGHALAENFETMGAVSRHPIYYPNLWRNKFQNLNVWEIITEIYTELVLYLEFARLADEQTKMLRHQFGPNTPSVEELRQRVQLLFVNTHPLFDNNRPVPPSVQYLGSLHLDRNNDVDEQQTMDYNLMQFLNNSTNGVVYVSFGTSIRVSDIDDEFLFEFITAFKQLPYNILWKTDGMPMEHVLPKNVLTQTWLPQHHVLKHSNVVAFVTQGGMQSTDEAIDACVPLIGIPFMGDQAYNTNKYEELGIGRNLDPVTLTSHILVSAVLDVTVNNKSRYTDNIKALNRSTNYRTRKPMEKAIWYTEHVIDNGKNPILKTKAANVSYSKYYMSDIIVPVITFLVMTHLGQAIRRLVVI

SEQ ID NO: 7334 - protein, 533 aa, Panthera tigris
MAARSRGPRPLVLSLLLCALNPLLSQGGKLLLVPLDGSHWLSLFGVIQRLHQRGHDVVVIAPEASVYIKEGAFYTLKSYPVPFRREDVEASFTGLGLEVFEKKPFLQRVVETYKRVKKDSALLLSACSHLLYNKELMASLAESGFDAMLTDPFLPCGPIVALRLALPVVFFLNSLPCGLDFQGTRCPSPPSYVPRVLSRNSDHMTFLQRVKNMLILVSEGFLCNVVYSPYASLASEVLQKDVTVQDLMGSASVWLFRSDFVKDYSRPIMPNMVFIGGINCASKKPLSQEFEAYVNASGEHGIVVFSLGSMVSEIPKEKAMEIADALGKIPQTVLWRYTGTPPPNLAKNTILVKWLPQNDLLGHPKARAFITHSGSHGIYEGICNGVPMVMLPLFGDQMDNSKRMETRGAGLTLNVLEMTSEDLANALKAVINDKSYKENIMRLSSLHKDRPIEPVDLAVFWVEFVMRHKGALHLRPAAHDLTWYQYHSVDVIGFLLAIVLGVVFIMYKCCAFGCRKCFGKKGRVKKSHKSKTH

SEQ ID NO: 7335 - protein, 522 aa, Spodoptera litura
MLFLVYLISFCSLVLDHSESARILAVFPVPSISHQVVFRPLTEELARRGHEVTVITTDPAFPKGGTPANLTEIDVHDISYDLWKSVFIEPATGKMDDVVLTLKLIYDAIAAIADAQFQDKEVKKIIRDKNKKFDLLLSEAIVRPALVFSHIYKIPVIQISSFGGALDNYENIGASIHPILYPAITRQRLHNLTLLEKITEVYDDYQIRRVYRNLEEIENKILRKNFGEDVPPVSELNNNVDMLFLNINPIFEGIRPVPPSVVYMGGLHQKPNKELPAELKSYLDSSKNGVIYVSFGTNVDPTQFPADRIAVLVNTLSQLPYDILWKWNGDVLPGRTDNIRIEKWLPQSDLLKHPKVKLFINQAGLQSTDEAISAGVPLIAFPVFGDQSYNAERYEFLKIGKKMNLETLTVEQFTNAIKTVIGDESYRKNIEKLRNVMRDQPQSPLERAIWWTEHVLRHGGARHLRGPAANMSWADYLELELVFTLLLGLLAVIAILFVILRSLYRLILEKTTKRCVKKVKRS

SEQ ID NO: 7336 - protein, 524 aa, Trichoplusia ni
MIKNANMDLYLYFVSCYVLLINSIDSAKILGVFPVPSISHQVVFRPLMLELAKRGHDVTVITTDPVFPKGEAPANYTEVDVHGESYRIWREGIKKVSNVGKGELRIQADDLKTFPIMFERQMNDEDVKRLLRDNKHFDLLILEACFRPALIFSHIYKAPVILMSSFGAMFDNYDIIGAPTHPILYPSFSFQKLNNLTMWDKITELYTLYKRAYFYARNLDFEDSKIRKHFGENAPSLAELGNNVDMMFLNVHPVFVGIRPVPPSVVFMGGLHLKPEKHLPEDLKTYLDSSKHGVIYISFGTNVDPTLLPPARIQVLVKVLSQLPYDVLWKWNGDELPGRTANIRISKWLPQSDLLRHPKIKLFVTQGGLQSTDEAITAGVPLIGMPMFADQFFNVEKYQYHKIGVRLDLKYLTEEQFRNTITKVISDDSFRQNIIKLHGLMRDEVQTPLERAVWWTEYVLRHGGAKHLRSPAANISWAEYLELELVFTLLGGVIVAVALGVFVVITIYKQLLRKCFSASKIKRS

SEQ ID NO: 7337 - protein, 544 aa, Dictyocaulus viviparus
MVMISSLLDWKCSDVKINENIKTYNLNASVGMKKEYMDDQKGKFMYEDIPIWDSRFRNRMSKVSTFLVETCRNILENKEFLEWLQVQKFDLAFSHMFDVCPIGLIHYAKIPSWIWLNSGPIMDFVAHSMGVPKVSSYVPPLMMESTDQMNFIERVKSLIGHSLSVILWKRMFADPETEYFRKLIDANFPDVVDVAKNCPLVMVNSNELYELPRPTLSKIVNIGGLGVQIKDAKPLPSEIKRIVDDSIDGLVVFSFGSVAPSHKMPLTWKNAFLDAFRKFPQYNFVMRYEENDLLDKLPSNVHIFKWLPQADLLAHEKTRVFISHGGYNSVQEAIIAGVPMITIPLFGDQLKNAKTVEKLKFTVNLKKRDVNTDKIVNALDRLLKDDSMSSMSPNYTENKLKIVSYSRNVKRLSRMVEKKPVKPEHLLVSWADMSYMSPNYTESKIKIASYSRNVKRLSRMVEKKPVKAEHLLVSWAEFVAEFKTLENLIPAGNELNFIQYHSLDVIAFLLILVTLIILTSWKFLMYIYEKMYTFLVDSQKQKKA

SEQ ID NO: 7338 - protein, 232 aa, Hibiscus syriacus
MSKIIGRLRKLGVSVRFLLATKTSRTRSKEVTEVQSMNNNVCSGLIHKNRTLHLRMPREHQHYKVSGTDRVGFRLGGIEQAVHLGPKRKRYNIEPSGEMDERGRVRRKNERKRACSQGMGSSSVPLITLPFLGDQFCNQKLAVQIPKTAVSLGVDKPTMFGDEKSGFMLNKEQVQNAIHQLMDEGEEGIERRKRAKEFGVMAKTAVDIEGSSYCNITLFIQDIIQQSQKMSA

SEQ ID NO: 7339 - protein, 526 aa, Papilio xuthus
MCTRLLLAIAAIIITDANAARILGLFPHTGKSHQMVFEPLLRTLAERGHHVTTVSFFPLKNPPANYTDVSLEGIAGLGLETFDLSIYESPNLLLKIPIVKRIAKQLMEFHPLAGMALNVCGKALDWPPLIEALKGDYDVVLVENFNSDCMLGLLHVYGIRAPVVALLSCNILPWSGNRIGVLDNPAFVPVLSTPFTSRMTFAEKLENTFIQLYHNFWFYYSIQVKERELIEKRFGMKIPDLYELGKNYSLMMVNTFHALNGVRLTVPGVVEVGGMHLDHTRKVIPPYIEKFLNESEHGVILLSFGSLIKTSTIPKYKEDMIVNALGKLKQRIIWKFEGSGEEGTLTGNILRVKWLPQYELLQHKKVVAFIAHGGLLGMTEAVSAGKPMVVVPFFGDQPANAAAAAEAGFATVVPYIELTEEKLIKALEFVLSAETRLNARRVSSIWRDRQADPLETAVYWTERVIRWGHHAQLHSPARDMPLYQIALLDVIATLAVAILILLAISWYILSKVFRLLFGRESKLKMQ

SEQ ID NO: 7340 - protein, 532 aa, Pieris rapae
MILIRKEVKDLLSIQAIEVCNQTEIQFCSPIFLVKKPNGQYRFILNLKRLFKGFFRLRPCAPKYDYTWNVSEVLNYIENFLATGHRAQTICTIDRDLIKIESNAVYIQVTKLVKTSAPNRLQPFIRLPFFCDRPFVCPACAVIDYLNMTKNIRKDSKNLFVSYRKPYNPVTVSTISRWTKTVLKESGIDMNTFSAHSTRHASTSTALKRGVSIDEIKRTAGWTDSSTCFARFYNRPIRNVTEKYTTLVNSSSSSDETPTGIISIERRLQNQPLPPNVVMVWGIHKKPQKPLPNDLQKYLDSSKNGVIYLSFGSNVLSSILSPEKIQVFVRVFSRLSYDILWKWETDELPGKSENIKISKWLPQSDLLRHPNIKLFITQGGLQSTDEAITAEVPMIAVPLLGDQWFNAEKYLYHKIGMKLDMETITEDELENAIKTIINDTSYKDNIRRFNILLHDQPQSALDRAAWWTEYVIRHGGAKHLRSIAANMPWTEYFEIDFALKLTSLLLSIIFGVLVVIYFVSRRFFTKEKLKSA

SEQ ID NO: 7341 - protein, 533 aa, Ornithorhynchus anatinus
MALLPAWACRMTCGILLWLTVRHFAEGKKLLVMPIGGSPWLSLLPILQKIEKRGHEIVVVSPDVSERIKLNPSYTLKQYPVAIQREHVDSEISYFAKFLFSNQTFVRKYFGLYRLTAAINSLAISACRNIFINQDLMKYLEDSKFDAILLDPSYPCGQILAEHLSLPTVYFILTLLCGLEAEASQCPTPFSFVPRDFSSNSDHMTFLQRVNNVFFGVVQYLFCFSLYTSYENLAREFLQRDVTLKELLSHGSVWLYRSDFVFNYPKPVMPNMVFVGGINCMVRNQLSQEFQDYVNDSGEHGIVVFSLGSMVSEIPVKKAMEIAEALGRIPQTVLWRYTGKPPANLAKNTKLVKWLPQNDLLAHPKTRAFITHAGSHGIYEGICNGVPMVLLPLFGDQMDNAKRVESRGAGVILNVLEMTSEDLSNALKTVITDKSYKENIMRLSALHKDRPVEPLDLAVHWVEFVMKHKGAPHLRPAAHDLNWFQYHCLDVIGFFLVITLSVFFIFFKSCMFCFRKCFPKKEKAKKSQKNKSH

SEQ ID NO: 7342 - protein, 511 aa, Papilio polytes
MKKAVLLVVLAISSISAHNILCIFPAPSRSHATLGRGIVNTLLQAGHQVTWVTAYPDKSSNKNLRQIDLPQSREIVNAMDVTSEGRMSVSLVREFARNISIAALESPELRNVLINEKFDAVVSEWFFSDVESGYAAVQQVPWILLSGVVMHPYMEFLVDSVRSLPVTPFMMNDFPVPMSLWDRLFNTFSFGMFMFGNWQDSSRAEADYDKYFAPIAKARGVPLPPLSISRHNISIMLVNSHSSFAPAQPLPPNVIEIAGYHIEETTPPLPKDLQDLLDSSRNGVVYFSMGSVLKSAALPRKTKQELLKVLGSLPYTVLWKFEEQLEGLPKNVHIRPWMPQASILAHPNVKLFITHGGLLSTLESLRYGVPLLGVPVFGDQPGNALRAMRSGYARKVTFSPDMAPELEKELKHMLADDKYYNKAKELSKLFNSRPVTQRQLISHYIQLAIDTKGAYHLRSKSLLYKWYELWMLDQLAIVVAILLLLYLLLKKIISALTKKNIKEVKKSKKNK

SEQ ID NO: 7343 - protein, 494 aa, Ooceraea biroi
MLESLMKGLANKGHQIDVISPYPQKKPYPNYTDIAKWATEEYVNNVTYEFVQVLAGSNPKIFATLFGSNICEAHLGNPVIQKLVRDPPKDPPYDAMIMEVRNNSLVLMKGLISKGHQVDIISPFPQKKPYSNYTDIANLTAPISFTNNMTYEFIVQVLGSIPWTSSATSYGNDICEAHLGNPVIQKLVRDPPKDPPYDAMIMEVFGAHCFTVIADLLNISLIGVSTTTLYPWLHELIAQPENLAFVPNNRLNVEFPMNLWQRTHNVFSFLYSKLYFNYHTRMQDDLVRMYFGPNLPSVQKMKLALFLVNSHIALHGIQPMTPAVIQIGGIHIRDDDSLLPQELKKWLDDSKDGFVYFTFGSMVLIETFPRKILDVFYASLDKIAPVRVLMKVPNPKKLPAGLPKNIRTFSWLPQLKVLKHPNIRAFITHGGLMSILEAIFCGVPMIGVPLFADQFKNVETSITRNVAVKLDVHKVTVKDMDAALNAILHDPRYM

SEQ ID NO: 7344 - protein, 445 aa, Eumeta japonica
MRECYPVKILALFPYNGRSHHIYFSTFVEELAARKHSVVVVNYFPLKNDSNLRQISLQEGGITRDTVEIEDSDGASGIFKEFSFAYDTAKAFKHIANDNCRRLVNNRHIKEMIDSEERFDVIIVEQFVTDCGFAIANRFKAPIVGMAAHVMFPWTYSRLGADDHPAFVPNHFTGAGPTPDLWERIKSTLINLFFNVYHRHFIQRSDNEIVREAFPDTPNLVTLVNNMSLLMLNQYFPLTGSRVYGANVVEIGGMHVKRQGIRDRNLQSFLDSAKNGVIYISFGSVASDLPKRKMEVILNVIKHSELRFIWKIENTDDFTIPSNVLTRKWLPQVDILCHENVLGFISHSGMLSSSEAMHCGVPVVSVPLFGDQFANAASARAVGLGVTIHLEDLEENTLDVALKTILRERHRWPSRRQGRLPLTVVLHGRQIAAPATVRPRIDVRK

SEQ ID NO: 7345 - protein, 682 aa, Temnothorax longispinosus
MLDQLRQMDTCTLGTQRLRRLFTTTTITTSTHLHYLLLSVLLAILVCDQIANGYRILGVFPLHGKSHWIMQEALMKELARRGHQVDVVTHFPLEKPIPNYTDISLKGSLPQVMNNMTAAEVLGFSTPSISNLVAMAGNNICALLDHPKIQELIKNPPQDPPYDIVIQELFAAPCYLAFGRHLKVPIVTTVASAFHDWLNEVSGNPMNPAYVPSLFSEYGQNMNFKERLTNFLLTHYLSWQMHYYTNAQLKFVLLSVLFAILVCDQIANGYRILGVFPLQGKSHWIMQEALMKELARRGHQVDVVTHFPLEKPIPNYTDISVKGSLPQVMNNMSAADLKAGFSTPSISMFVAMAGNAICALMDHPKIQELIKNPPQDPPYDIVIQEMFAAPCYLAFGRHLKVPIVATVASVFHDWLNEVSGNPANPAYTPSFFSEYGQNMNFKERLTNFLLTNYLSWQLHYHTNTQLKFVKEHFGMDLPHIKDLYSDVALYLVNSHHSLNGIRPMTTNVIEVGGLHLKDDDNPPSPEVQKWLDESKDGCIYFTFGSMVRIETFPKEMIQQIYASFEKIAPVRVLMKVAKKEDLLPGLPKNVMTQSWFPQISVLKHKNIRAFITHGGIFGTQEAVYCGVPMIGIPLFGDQIVNIKNYVNKKVAISLNSVTEVTEEKLTSAINNILKDPSYRENL

SEQ ID NO: 7346 - protein, 532 aa, Gallus gallus
MALVLPSHPQVSVSLLLLLSVLSLAAGGKLLVVPVGGSHWLSMQEVLDGLRQKGHEIVIVSPEFNLFVKPSNNFTMKLYQVPVTEEEINGDFQAFLKEAFEEGSFVERFLRVRERVKKLYELGFIACEQLLKNKELIRYLEESNFDALFTDPVLPCGAIVAEHLSIPSVYLLRGIPCGLHLEATQCPSPPSYIPRLFTDHTDHMNFLQRVKNVIFDTSNLFLCDFLFKPYEKLASEFLQRDVTVLDLLRKASIWLLRYDFVLDYPGPLMPNIIVVGGVNCAHKQLPQEFEAIVNASGEHGIVVFSLGSMVSEIPMKKAMEIADALGSVPQTVLWRYTGEVPPNLPKNVKLVKWLPQNDLLAHPKTRAFITHGGSHGVYEGICNAVPMVLMPLFGDQMDNAKRVESRGAGLTLNILEMTSKDISDALKAVINDKKYKENIQRLSDLHLDRPIHPLDLAVHWVEFVMRHKGAPHLRPAAHDLNWIQYHSLDVFAFLLAVVLLSLFISVKCCMFCCRRCCFKKGRKSKSGKSKTH

SEQ ID NO: 7347 - protein, 689 aa, Camelus ferus
MGPQVLAGLLLCLCAGPWAEGGKVLVVPMEGSHWLSMREAVRELHARGHHAVVLSPEVNMHVKPEDFFTTETYATPNTQDEFDYVMMGQVHVLFERVNFLKMFWNTMVGLKNASLIFQRSCEALLSHKDLIRRLNASSFDVVLTDPVYPCGAVLAKYLSLPAVFFLRGIPCDFDVEGTACPNPFSYVPRLLTRNSDHMTFLQRVKNMLYPLALKYICHASYTPYQRMASELLQREVSLVEVFSSASVWLFRGDFVMDYPRPVMPNMVFIGGLKNASLIFQRSCEALLSHKDLIRRLNASSFDVVLTDPVYPCGAVLAKYLSLPAVFFLRGIPCEFDVEGTACPNPFSYVPRLLTRNSDHMTFLQRVKNMLYPLALKYICHASYTPYQRMASELLQREVSLVEVFSSASVWLFRGDFVMDYPRPVMPNMVFIGGINCANRKPLSQDFETYINASGEHGIVVFSLGSMVSEIPEYKAMEIADALGKIPQTVLWRYTGTPPPNLAKNTKLVKWLPQNDLLGHPKTRAFITHSGSHGVYEGICNGVPMVMLPLFGDQMDNAKRMETRGAGVTLNVLEMTSEDLEKALKTVINDKSYKENIMRLSSLHKDRPVEPLDLAVFWVEFVMRHKGAPHLRPAAHDLTWYQYHSLDVIGFLLAVVLTVVFIAFKSCVFAYRKCFGKKGRAKKAHKSKAH

SEQ ID NO: 7348 - protein, 590 aa, Dendroctonus ponderosae
  MOD_RES (284)..(320): Any amino acid
MLSGNSRALQCWTLLLILSGALGAKILGIFPTPGRSHYILESTLMRALSDAGHQVTIVSPFHEPYQSAGNGSYRQIVLTGVAEAQKGPKNREIPQRRRGINLFERASMNPLSAIYVMNKIGLKQTESTLQHAAFQALIHSGERFDAVVVGQFMNDALKGMAHHFGGHLILFSSVGTSTWVSKSINEFLSKIGKKFQNSNRAQSDPVGFARHSRQMSQQPGARRHAPDKERTSRARFFGAKLIKICEQVNHLVGNPSMPSYTPEMILSYPARMTYWQRATNALVXXXXXXXXXXXXXXXXXXXXXXXXXXXXXXXXXXXXXSLVLMNTHESIAFPTSAVPCMKHIGGFHVKAPAPLPNELQAFLDQAAEGVVYFSLGSNVNTSHLPAPMRQAILEVLAQRPQRILLKFDEPPATPLPANVMQRAWFPQQDVLAHPNVRLFITHGGFASTIETVHYGVPIIAIPIFGDQRMNAIYAETKGFGRILPWQSINVASFGRMVAEVLGNPRYREAARRKSQLLRDREVAPLATAVYWIEYVLRHNGAPHLRVASLELAWYQYYLLDVYLPIVLLPVVVWQVLRRLMPRRGQKIKTS

SEQ ID NO: 7349 - protein, 245 aa, Tyto alba
EFEDIVNASGEHGIVVFSLGSMVSEIPMKKATEIADALGSVPQTVLWRYTGQAPPNLPKNVKLVKWLPQNDLLAHPKTRAFITHGGSHGVYEGICNAVPMVLMPLFGDQMDNAKRVESRGAGLTLNILEMTSKDISTALKAVINDKKYKENIKRLSELHLDRPIHPLDLAVHWVEFVMRHKGAPHLRPAAHDLNWIQYHSLDVIAFLLAVVLLSLFISLKCCLFCCRRCCCKKGRTRKPTKSKSH

SEQ ID NO: 7350 - protein, 524 aa, Zygaena filipendulae
  MOD_RES (280)..(280): Any amino acid
MANAARYILLIGILYINFIKICEAARILAVYPTPSISHHKFFWPFTEELAKRGHEMVVITTDLAYPKGEAPPNITEIDLHDISYDIWQRDWVTELSGRTNDQYYILRGLITTMAKVVIAQMKSDEVQAILKDERGFDLLLIEDWTRTALGFSHVFKVPTILVSSFGSLFGHYGDLGVQMHPLLYPILSSQRHYGLSLWEKIYEFYRVLCVQYFYITYEEEENKMLRQVLGDDIPTLSELSKNVDLLLLNHHPVWDFNRPVPANVIYVGGKRPIPRKELPXDIKSFLDQSVNGTIYMSLGSNVKPSILSKDRIGMMMKVFSELPYDVMFKYDQDELPGKPSNVRISKWFPQPDILRHPKVKAFITQGGLQSTEEAIETGVPVIGMPILGDQWFNCAKYNHFKIGFGLEFESLTEEIFKNAIKSVIEDESYRRNIKNLRELLYDQPQSPMDKAVWWTEHVLRHSHIGKPYRSPRAEITWVEYLELKLVAVLLTIFALTSIIVAKIAILLFKFLSKSISTSVKVKMN

SEQ ID NO: 7351 - protein, 527 aa, Copidosoma floridanum
MGVPRNRSLLVISIVLVACCSQCVDGLRILGLFPLHGKSHFSMCESLMKGLAAKGHQVDVYSHFPQKKPVPRYTDYSLDGTLPAVVNNITYDYIQRFDSPNIKFMMEELANKVCELMSTSEFQKLFQRLEKNQPYDVVIMEVFVSNCYLAWGRFLKIPMVGVMTSSLIDWYNEPLGNPLNLAVTPSSWSHLYHPMNFWERLTNAFMYNVIVMQTKYYIRCQDKYIEQYFGTGYPNSNDIIRDLDLLLVNMHHSVNGIRPFTPAIVPVAGLHIQDDDPNLPKAVQKWLDESTSGCVYMSFGSMVRIETLPKAILTGIYETFKKLAPVRVLLKIAQPQELPPGLPSNVMTQTWFSQMKVLKHKNLKAFVTHGGLGSTQESLSAGVPMIGVPLFGDQHINVRSQVRRNIATMVDIKNFDTNAFYSAVKEVLGNPIYKKNAEEVARDFFDRPMSPMDEATFWVEYIVRHGKQSLKSPVVDMPWYQAHMIDVYGFVLLVLVVACYVVKAIVRKILRLFCSSSSAPGKKKKRE

SEQ ID NO: 7352 - protein, 533 aa, Rhinolophus ferrumequinum
MAAGSQGPHPLVLGLLLCALGPAVSQGRKLLLVPMDGSHWLSMHGIIQQLQQRGHDIVVLASAASVHITEGEFYTLKRYPVPFRREDAEASFISVGHNAFERQPFLQRVIKTYKKVKEDSAMLLSACSYLLHNTELMTSLAESNFDVVFTDPFLPCGSIVAQYLALPAVFFLNALPCSLDFQGTQCPNPPSYVPRSLSFNSDRMTFLQRVKNVLIALSENFLCSVVYSPYASLASEVLQKEVTVQDLMSYASVWLFKGDFVKDHSRPIMPNMVFIGGINCASKKSLSQEFEAYVNASGEHGVVVFSLGSMVSEIPEKKAMEIADALGKIPQTVLWRYTGTPPSNLAKNTILVKWLPQNDLLGHPKTRAFITHSGSHGIYEGICNGVPMVMLPLFGDQMDNAKRMESRGAGVTLNVLEMTSEDLANALKTVINDKSYKENIMRLSSLHKDRPIEPLDLAVFWVEFVMRHKGAPHLRPAAHDLTWYQYHSLDVIGFLLAIVLGVAFIVYKCCAFGYRKCCGKKGRVKKAQKSKAH

SEQ ID NO: 7353 - protein, 1187 aa, Sorex araneus
MASRVLAALLPLSVCLLLVPGPTEAGRLLVVPMDGSHWFTMSSVVEQLVQRGHEIVVVMPEVSWQLKKSFNVTVKTYSLSYSLEDVNREFKRYVDVQWKIRDQNFLSMMMATPTQFFEYFFSHCKSVFDDRKLIRYLEETSFDAVFLDPFDMCGLIIAKYLSLPSVVFTRGVFCHYQDEGTQCPSPLSYVPRGLLALSDTMTFPERVWNLLFHVQEHLFCRYFLKVATDVASEIFQTTITPYDLYSQASIWLLRTDFVLDYPRPVMPNMVFIGGINCHAGKPLTEVSWQLKKSLNFTAKTYSLSYSLEDLNHEFKIFADHQWKIRGKSLLSALMSLSSRFFDNFFSHCKSVFNDRQLVRYLEETSFDAVLLDPLDMCGLILAKYLSLPSVVFTRGGFCHYQDEGTQCPSPLSYVPRRLLAFSDTMTFWERVRNLLSLVEEHLFCHHFLKVATGVASEIFQTTITPYDLHSHVSIWLLRTDFVLDYPRPVMPNMVFIGGIKCHAGKPLTEGGKMLVVPMDGSHWLSMRKLVQELHSRGHQIVVVVPEVNLYIKAEDFFTLKSYAVPFTQEEFQHILVGQGKLIFEEKYSLVIFWKIMDILKEISQLFLSSCRELLNNKDLMVSLRNSSFDVLLTDPVYPCGAVLAQYLSIPSVFFLRDIPCDYAFEGTQCPNPFSYIPKYLTAHSDHMTFLQRVKNMLYPLSLTYACNIGLLPYEGLASEVLQREMSLGEIFGSASVWLFRGDFVLDYPRPIMPNMAFIGGINCAYRKPLSQEDSALFLSFCSSLLYNKELMASLAASNFDLMLADPFLPCGPIVAQHLGLPSVFYLNAMPCSLDYQGARCPNPPSYVPRSLSMNSDHMTFLQRVKNVLIASTESFLCSAVYSPYAQLASEFLQKTVTVQDLMSNASVWILRSDFVNYHPRPIMPNMVFVGGINCANQKPLAQEFEAYVNASGEHGIVVFSLGSMVSDIPEKKAMEIAKALGTIPQTVLWRYTGTPPSNLAKNTKLVKWLPQNDLLGHPKTRAFITHSGSHGIYEGICNGVPMVMLPLFGDQMDNAKRMESRGAGVSLNVLEMTSEDLSQALKAVIYDKSYKENIMRLSSLHKDRPIEPLDLAVFWVEFVMRHKGAPHLRPAAHDLTWYQYHSLDVIAFLLSIVLGVLFVVYKCCAFGCRKCFGKKPRGKKSHKSKAH

SEQ ID NO: 7354 - protein, 959 aa, Tribolium castaneum
MPFPVKSHSILFETLLKRLAEKGHEVDYVTHFLSEKTPERYNELSIRGSLPLFHNNFSVKALKDHSVYETIKFVTTSGGVDANSAIMKTAVLQSLKNTTKQYDLIITHLFGSDAMLGFGHLFNAPIVSITTCAVLPWAHGRIANPDNPSYVPNFYTSFLPKMNLYERIENTILWIMTRIWYNYLTMAPSNRLVKDFFGPDTPSLENLIQNTSLVLVNSHFSMQQVRPTVPNFIEVGGLHIREPQPLPKDLENLVSNNTFGVVYLSMGSMVITETFEPEILQAMFDAFAELPYTVLWKASPEKFPKGLTIPENIHFKTWMPQIDILCHPNVKLFISHGGLLGSQEAVYCAVPRIGIPLYGDQEANIHKSEKLGIAIKLAYGSITKDSFLETVKRVLEDLSYRHNVQKISQIFKDRPMSPLDTAVYWVEYVIKYKGAPHLRSVGADLPWYQYYLIDVAVILLFGLFVKFQDLENLVSNNTFGVVYLSMGSMVRTESFKPEILQAMFDAFAELPYTVLWKASPEKFPKGLKIPENIHFKTWMPQIDILCHPNVKLFISHGGLLGSQEAVYCAIPRIGIPFFDDQELNIVTYNELSLYGTLPDHVNNLSIEGMQNQTIYQRIKFMTRTAGVEAFSRILQTPVLRNLRNTTKKYHLIIVHQFGCDVMLGFGFLFNAPVISYVTSVSPPWIDDRIGNPDNPSYIQSHFSRSSAKMSLYERVENTIFWISARFWYSFFSGRSDQLVKDFFGHKTPSLENLIRNDSLVLVNSHFSLQQVRPLVPNFIEVGGLHIREPQPLPKDLENLVSNNKFGVIYLSMGSMIMTETYDPEILQAMFDAFAELPYTVLWKASPEKFPKGLKIPENIHFKMWMPQIDILCHPNVKLFISHGGMLGSQEAVYCAVPRIGVPIYADQERNIVTSEKLGIAKKLSYDHINKNTFLHTIKELIEDLKYVWLKKKLLLSNFC

SEQ ID NO: 7355 - protein, 534 aa, Caenorhabditis remanei
MHVNSLLFLLSIFGTCVFGKNILIINPIFGFSHVKFMTQMANVIADHGHNVTLFQPFHIPLKNMDGLVKNKNIEILNYYPDHYDELLNTESPTFPMFWDSHLMNNPVLQSVMMPRMIVKELQRTDEQILLDTKLHETLKNKKFDVAIAETFGISGFYLAHFLDLPCIPVMSAVRFQVFNELFGQLSSTGYIPQIGSKRASEAGFLDRLNDVYMKFFDKITVEKMGQLQNDNFENALGRPLPNWKDLISESPVYITNSNPYLDFAVPTTATIVHAGGITIDLKKLRNVGPLPEEYEQILQERDSTILISFGSVIRSYQMPDNFKAGIIQMFESLPDVTFIWKYEKDDVEFQKRLPKNVHLKKWVPQPALLADKRLKVFVTHGGLGSTMEVAYTGKPALMVPIFGDQPQNAYMLERHGGAIAYDKFDLQDGDKLTKIMKDMVTNPKYNENAHALLEVLSNQPIDPKMNLMKHLDFAIKFPKLRSQVPAISHVGIIAHYYLDVFAFLTSVAVVLAYCTFKLLRKIPVRLAAKKTKND

SEQ ID NO: 7356 - protein, 533 aa, Apaloderma vittatum
MAVVLRAHPQLAATLVLLLSVLSSAAGGKLLVVPLDGSHWLSMREVLDVLSQRGHEVVVVAPEISLHIKPTKNFVMKMYPVPFTQEELNNAFLRTSQEVFEGGSFLERFLKTYDRLKNASAMFLSTCAHLLSNKELIQYLQESKFDAVFTDPILPCGQILADHLSVPSVVFVQQIPCGLEFEATQCPNPPSYVPRIFMSSSDHMTFTERVKNHLVGISGNWLCYLFYLKYENLASEFLHKEVTILELFSKASIWLMRYDFVFEYPRPIMPNMVYVGGINCEQKEPLPKEFEAIVNASGEHGIVVFSLGSMVSEIPMKKATEIAEALGTVPQTVLWRYTGQTPPNLPKNVKLVKWLPQNDLLAHPKTRAFITHGGSHGVYEGICNAVPMVLMPLFGDQMDNAKRVESRGAGLTLNILEMTSKDISTALKAVINDKKYKENIKRLSDLHLDRPIHPLDLAVYWVEFVMRHKGAPHLRPAAHDLNWFQYHSLDVIAFLLAVVLLSLFISVKCCMCCCRRCCCKKGRTRKPTKSKSH

SEQ ID NO: 7357 - protein, 430 aa, Fopius arisanus
MGIWKFWKWMLLVIFVGECGGYRILGIFPFNAKSHMMMFEQLMKGLARKGHQVDVVSPFPLKTPVRNYKDIEIPSALPKLVNNMTYEGMKEIMKNNIVKFIALEAGNRVCAEGLEHPELQRLIKNPPKNPGYDLVIVEIFSAHCFMAFGPHFNVPVIGISSAALYPWSNDIIANPENLAFVPNNLLEYKKSMDFWERLYNFLHTYYYKRYFDYHTSPQNDIIRKHFGPDSPGIRELERDLALIIVNSHYALNGVRPTTPGLIEVGGVHIQDDGPDIPQDDRKWLDESPEGFVYFTFGSMMQIESFPPHVLDILYKSLGKISPVRVLMKIPRRELLPPGLPGNIRTFSWMPQLKVLKHPKIRAFITHGGLMGTQEAITCAVPMIGMPIFADQFVNIDLYVAKKIALRVDPVQMTEEKLDWALNEILFNPVY

SEQ ID NO: 7358 - protein, 273 aa, Capitella teleta
TTFDQIYKDSEMWIINMETVCSDQPRVHAFHYQFIAGLGWTPAKPLPAGNIQSFADGADNGLIVVSFGSALKTIPKELMDVLMETFENLPQRFIMRFDSEHPANTPSNVMLVSWLPQNDLLGHNNTRLFITHGGNNGQLEGLFHGVPMLTLPVFGDQFYNARRAFLRGHGLFLDLKSSSARQIHGAITELLLNPKYRKSVQRCSRILLDMPEPRKALSFWVNHVLKFGGSHLKPSSMQLPLWKFFMLDVAAFLAVSAAIMSACIFMCCRCTAK

SEQ ID NO: 7359 - protein, 530 aa, Trichinella nativa
LKHRRVRKQITRAMQINITLYVFICLTYGFISELFSKEFRGNVLHFAFGISKSHVLFNERLANVLSENGYKVHIVFAPVAPDVDLPDFRNNKNVEVIKINFTITESVFTLGKQWQNDIFKKDSIKNIFVIGRMFQRLLIDSCKIMSENSALKQHIETIQYDVLLNYCLDICPLAFGWKGKIPKTICISPSTIIFESVASIVGTPIRPSFIPNGGSAYSDKMTFFGRLKNSLLSSFMLLYPQLPVSAHKTEENIFRTIYGNDFKSITELNSNIVGMLINGEASLEFPRPLLPTVLYLGDLLPLKSSRLSKEWQHVVEAENAGIILFSFGSVIKTDLIPWEIQKELLDAFSRFPNYTVVCKLSVDESQKHYLPPNVKLFDWIPQRELLDHPKLKLFITHAGYNSLLETAKVGVPMITIPLFGDQLSNALRAERQKLSLVLSKLEITSENLENKMKIILENETYFNRAKQFAGFIHDKPLSNADMLIRYMDITIRRQQLVRPAVLNFNVMQEFNFDSVILATSAFLILLSLVR

SEQ ID NO: 7360 - protein, 532 aa, Pelodiscus sinensis
MAPSSQSEHPIVSRLLLFLVVCSLAEGGKLLVIPVDGSHWLSMCQVLEKLSLKGHEIVVVMPEVSLLIRPSLYYSVKTYPVPHTKEKLDVFFQSLIYLIFDDGPILKKVFIAYESFTSVNTMMLTTCKHFLLNKEVMKYIEEVHFDAILTDPVLPCGSIVAEYLSIPSVNFLRGVPCSLDKAIQCPDPPSYSPKFLTSYTDHMSFTQRVMNFLFGALEHLFCKLLFSQFDSLASEFLQRDLTILELLSQSSVWLMRYDFAFEYPRPVMPNMVFIGGINCGQKKKLSWEFESIVNASGEHGFVVFSLGSMVSEIPMKKAQQFAEAFGTIPQTILWRYTGQPPPNLANNTKLIKWLPQNDLLAHPKARAFITHGGSHGIYEGICNGVPMVLMPLFGDQMDNAKRIESRGAGVTLNVLDMTSKDLSAALNTVIYDKSYKENIMRLSALHLDRPIHPLDLAVHWIEFVMRHKGAPHLRPAAHDLNWIQYHSLDVIAFLLAVVLVAMFISWKCCLFCCRKCFCKKGRVSKSSKTKAQ

SEQ ID NO: 7361 - protein, 531 aa, Mus musculus
MAPADFPASLPLCVCLLLASGLAQAGRLLVVPMDGSHWFTMQTVVEKLLHKGHEVVVVVPEVSWQLTKPLNFVVKTYAVSHTQEDLNREFKIFIDAQWKSQQEGGILPLLDSPAKGFFELLFSHCRSLFNDKKLVEYLKQTSFDAVFLDPFDVCGLTVAKYFSLPSVVFSRGIFCHYLEDAAQCPSPPSYIPRMLLKFTDTMTFKERTRNLLAYMGERAFCHKFFKSAADIASEVLQTPVTMTDLFSPVSIWLLRTDFVLEFPRPVMPNVIYIGGINCHQGKPLSKEFEAYVNASGEHGIVVFSLGSMVSEIPEKKAMEIAEALGRIPQTVLWRYTGTRPSNLAKNTILVKWLPQNDLLGHPKTRAFITHSGSHGIYEGICNGVPMVMMPLFGDQMDNAKRMETRGAGVTLNVLEMTADDLENALKTVINNKSYKENIMRLSSLHKDRPIEPLDLAVFWVEYVMRHKGAPHLRPAAHDLTWYQYHSLDVIGFLLAIVLTVVFIVFKCCAYGCRKCFGGKGRVKKSHKSKTH

SEQ ID NO: 7362 - protein, 520 aa, Trichoplusia ni
MGVLLYFLTSYILLINCNEAARILVVVPTPSVSHQVVFRPVVQELVKRGHHVTMITTDPAFPDGGGPANLTEIDVHDISYRVWRQHLMKATQGNQEDLYFQMKTIVTMALEVFEYQYNDEKVQQLINDKNQKFDLIIVEALSRLALGYQHVFKAPLILMSSFGATIDNFEALGVPTHLLLYPMIIRQRINNLTIWDKISEVYHFAKLYTMFESCMEDDEKLLRKLFGPDVPSVREFYNRIDMLFLNENPVFSGIRPVPPNLIYMGGLHQHPVKELPKDLKSYLDSSKNGVIYISFGTNVDPTQLPADRIQVLVKAFSQLPYDVLWKWNGDELPGRTENIRISKWLPQSDLLRHPKIKVFVTQGGLQSTDEAITAGVPMVGFPMLVDQWFNVERYETHKIGIKLDIATVTAEKFKNTLLKVIEDDSYRQNTVRLNILMRDQPQAPLERTIWWIEHVLRHGGAKHLRSPAANISWAEYLELELVLTLLAGLLTAISLVVLCIYYLFKFFVKNGVSNSKVKRS

SEQ ID NO: 7363 - protein, 522 aa, Bombyx mori
MFKLTFLVCCILATQSVSDAYKILVVFPMPGKSHSILGYSVVKHLLKAGHEVTYVTPFVEDNHHPNLTQVDVSSNMRLIPKGGLDLKRVLDKEVNVIDNGFMFYFMKQIQEATLEHEQVKKLLEDPNKTFDIVIVEWMYCELGASYAAVFDVPLIWLSTMEPHWLVTRLIDGNLNPAYNGDSMSSSIPPFTFLQRVKELWIQIHTSFILLNDDQERSYDRLVRPLIEKKGRKAPSFEDLKFNASLVLGNSHVSLGEATGTPQSYKPIAGYHIEEVVKPLPADLKEIMENAKHGVIYFSMGSNLKSTEMPDEMKQNLVKMFGELKQTIIWKFEEDFPNLPKNVHIVNWAPQPSILSHPNCVLFITHGGLLSTTESVHFGVPIVGIPVFGDQFINVQRAVKRGFAKKVDFSYSMVGELKVAIQEILSDSSYRTRIKELSLIYHDRPVSPGAELVHWVEHVARTRGALHLRSPALHVPFYQKLYLDLLAVVLIISLIFYRKICLIKNLLLSFFQTNEIKKKKKRN

SEQ ID NO: 7364 - protein, 441 aa, Aethina tumida
MYEKIPKIVKKLMAKMDENIYSQMISHFEVMRMFEEEILGSKGVLELLGNKNIQFDLVMMEMISNIGLGFGYKYKAPVVGISSVGGLAQIHEVMGNPRHPAFVPEIFLGFGERMTFLERIQNTAFNVWYRYYHHWINVPDWDKIARKFFGNEMPYLGDLEKEIPLVLVNTNPVLDYVKPSVPGVIEIGQMHIKPKKPLPNDLKDYLDNSKKGVVYFSLGSNVLSSNTAPEFLNAIKEAMSELPYDFMWKWETDDLPNKPQNVLIRKWFPQQDILDHPNIKAFVTQGGLQSMEEAITNGVPMVVIPYFGDQPYNAKRMVHMEIAKELNYKMLTKENFKQAVTEVVENDKYKRNVVKYSKLLVDQPMTGLEKAVWWIEFTLRHKGDFNLRGYGADVPYYQYFFLDIIAFALIIVLATILSVRKIVNIIIRVNARKSSKKIKRN

SEQ ID NO: 7365 - protein, 523 aa, Galeopterus variegatus
MAGRRALLLVGFLLPGVLLSEAAKILTVSTVGGSHYLLMDRVSHILQDHGHNVTMLHHGGYSLMSDFEEEKKSYHVISWLLPEGDNKEFKKSINFLMGETLRGRGLFENYLKFLEQLGFQCSHLLGRRDIMDSLKNEDFDMVIVEFLDYCPFLIAEQLGKPFVSILSSSFGTVDFGLPSPLSYVPVYRSLLTDHMGFWGRMKNLLMVFDFSIKEWQTQSMFDNTIKDHFPEGSRPVLSHLLQKAELWFVNSDFAFDFARPLLPNTVYVGGLMSKPTKPVPQDLENFITKFGDSGFVLVSLGSMVSIHQIEEVLREMNSAFARLLQGVIWKYKSSLWPKDVKLAGNVKLVEWLPQNDLLAHPSIHLFVTHGGQNSIMEAIHHGVPMVGIPLFGDQPMNMVRVEAKEFGVSIQLKDLTAETLALKMKQVIEDKRYKSAAVDASIIMCSHPLTPAERLVGWINHILQTRGAAHLKPYSFQQPWHERYLLDVLSFLLAFTLVTVWLCGKLLGMVAKWVCGSRKLKKT

SEQ ID NO: 7366 - protein, 522 aa, Culex quinquefasciatus
MYRIAVILFCAFEFSFGKNILILSGVPSPSHSIWIRPLATALAADGHNVTVVSPDIEKKPPVNLTYVHLETLYSEMYNTSQRDNLQFFEMADEGPLKMLSFLDEFTIIMCKASIRSVGFKHLMDYPKDFKFDLFMSDYMIGPCLASLLMYRFGSPPYIPVAPYNALATSAPLIGSYAYSASIPNHSFDVPLKMSFLERVQNFFYDSYEELRKDTYLYPETDAIIRSVFPNAPSARELQSNIKLLFINNNPLIQYKEPMMPNVIPVGGMQIRPPKPLPDDLNRIVSKAKNGFILFSLGSNARSDLLGPDRIRCVMTAMKAFPQFQFLWKFESDESKLPMAVPENVFIRAWMPQNDLLGHPNIKLFMTHSGLLSTQEAIWNGVPILGFPLFADQFRNINYCSSIGVAQRQSIQRCNAQELIETIRELTGNPSYNAKMKRLSQLVQDQPETPLQRAVWWVNWVLRNPDVSVLQSSVMQMGWMQKYLIDVFLFIVLSTVLIALLIIIFSMKVIKQLGKSSTKQKRQ

SEQ ID NO: 7367 - protein, 520 aa, Spodoptera litura
MSVLWCIVSAYIIVVSPIQASRILFYIPTPSISHQVVFRPLAQTLASRGHDVTVITADPAFPKGKSPANLTEIDVHDMSYEIWQEGIMKETRGDTGDLKAQLAPVMRTLYTVFDKQLQEEKIQNLINDKNKQFDLVILEGVLPPLLVFSHIYKAPAILMSSFGGLYGHYESVGAPTHPLLYPLNIRQKLGDLTLWDKLRELFVYYAVENLWYSFYDLGNSILKKHFGPDVPNVWELMDNIDMLFLNIHPMFEGIRPVPPNVIYLHGLHQKPKKDLPQDLKSYLDSSKHGVIYVSFGTNVDPALLPPEKIQILVRVFSQLPYDVLWKWSKDELPGRSPNIKIAKWFPQPDLLKHPNVKLFITQGGLQSTDEAITAGVPLIGMPMLGDQYFNVERYVYHGFGIRLDMEALTEEKLKHAINATVEDESYRRNMERFRTLINDSPQTPLERAVWWTEYLLRHGDAKHLRSPSANISWRQYLELDLVLVLLSVLLIAVAVIVIVLRLVYRALRFYRVGDVKIKRN

SEQ ID NO: 7368 - protein, 530 aa, Homo sapiens [sequence omitted]

SEQ ID NO: 7369 - protein, 541 aa, Aotus nancymaae
MSVASAEMTTGLQFLLLQLATGLLLLLSVQRWAESGKVLVLPTDGSHWLSMREVVWKLHSRGHQAVVLTPEVNMHIKEEDFFTLTTYAIPYTQDEFNHLLLSHTQLFFETEHFLKKFSRSIEILKNMSLFAHGACVELLHNETLIRHLNATSFDVVLTDPVYLCGAVLAKYLSIPAVFFLRYIPCDLDFKGTQCPNPYSYVPKLLTTNSDHMTFLQRVKNMLYPLTLSYICHAFSAPYASLASELSQREVSVVDILSHASVWLFRGDFVMDYPRPIMPNTVFIGGINCANRKPLSQEFEGYVNASGEHGIVVFSLGSMVSEIPEKKAMEIADALGKIPQTVLWRYTGTQPSNLANNTILVKWLPQNDLLGHPKTRAFITHSGSHGIYEGICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAIVLTVAFIAFKCCAYGYRKCFGKKGRVKKAHKSKTH

SEQ ID NO: 7370 - protein, 532 aa, Mesocricetus auratus
MATEFHMPLQGLVGLLLLCALPWTEGGKVLVIPVEGSHWLSMRDVVRELHAHGHQTVVLAPEVSVHIKKEDFFTLKPYAVPYTKQGYERKITQNINLAFETGNYVKTFLKLTEAIKNISTDVFKSCLDLLHNETLIQHLNSSSFDVVLTDPVLPCGAVLAKYLRIPTVFFLLYLPCDKDSEATQCPSPSSYIPSLLTRLSDHMDFLQRVKNMLYPLALKYVCHVSFTQFESLASELLQREVSLVEVLNHASVWLFRRDFVFDYPRPIMPNMVFIGGINCANRKPLSWEFEAYVNASGEHGIVIFSLGSMVSEIPEKKAMEIAEALGRIPQTVLWRYTGPKPSNLAKNTILVKWLPQNDLLGHPKTRAFITHSGSHGIYEGICNGVPMVMMPLFGDQMDNAKRMETRGAGVSLNVLEMTVDDLENALKKVINDKSYKENIMRLSRLHKDRPIEPLDLAVFWVEYVMRHKGAPHLRPAAHDLTWYQYHSLDVIGFLLAIVLTVVFIVFKCCAYGFRKCFGKKGRVKKSHKSKTH

SEQ ID NO: 7371 - protein, 532 aa, Gallus gallus
MDSFSPCNMLMAVLLPFLCYLNTAAAGKLLVIPMDGSHWLSMKEVLAELSSRGHEIVVVAPDSSILIDSSGNYTMKTYPVPYKQEEMEELLHTIGTTSFSEFPLLTRLLDTWEHFRKTSAMFQAACSSLLYKEELMKFMEESKFDAVFTDPLTPCGQIVALHLSIPTIFFLRGVPCSIDIYAAQSPSPPSYVPRLFSYSTDHMTFPQRVKNLLISISEYFTCSTIFSPFERLASDFLQQPMTLTQLLSHGSIWLKRTDFAFDYPMPVMPNMVFIGGINCGRKKLLAQEFEAIVNASGEHGIVVFSLGSMVSEIPMKKAMEIADALGSVPQTVLWRYTGEVPPNLPKNVKLVKWLPQNDLLAHPKTRAFITHGGSHGVYEGICNAVPMVLMPLFGDQMDNAKRVESRGAGLTLNILEMTSKDISDALKAVINDKKYKENIQRLSDLHLDRPIHPLDLAVHWVEFVMRHKGAPHLRPAAHDLNWIQYHSLDVFAFLLAVVLLSLFISVKCCMFCCRRCCFKKGRKSKSGKSKTH

SEQ ID NO: 7372 - protein, 533 aa, Sorex araneus
MAAESQLLRAVALGLLLCVLGPGATQGGKLLLVPMDGSHWLATLGVIQRLQQKGHEIVVVAPAASVHIREGPSYTLKKYSVPKGREEMQRIMAKLGRRVFEDKPFLQRVVEAYQSVKEDSALFLSFCSSLLYNKELMASLAASNFDLMLADPFLPCGPIVAQHLGLPSVFYLNAMPCSLDYQGAQCPKPPSYVPRSLSMNSDRMTFLQRVKNVLIASTESFLCSAVYSPYAQLASEFLQKTVTVQDLMSNASVWILRSDFVNYHPRPIMPNMVFVGGINCANKKPLAQEFEAYVNASGEHGIVVFSLGSMVSDIPEKKAMEIAKALGTIPQTVLWRYTGTPPSNLAKNTKLVKWLPQNDLLGHPKTRAFITHSGSHGIYEGICNGVPMVMLPLFGDQMDNAKRMESRGAGVSLNVLEMTSEDLSQALKAVIYDKSYKENIMRLSSLHKDRPIEPLDLAVFWVEFVMRHKGAPHLRPAAHDLTWYQYHSLDVIAFLLSIVLGVLFVVYKCCAFGCRKCFGKKPRGKKSHKSKAH

SEQ ID NO: 7373 - protein, 414 aa, Aethina tumida
MKRVPIFCALLSLAQCANILFVTSFPSHSHQVMFQPVWKELSLRGHNVVAITPNPLRDESLTNLTEVDISKVYEKIQEARAPIPALDTVGNPSHPVYAPDHNLPVGRDMTFRERLLSALWAFYVRITYHTIILPREDALARKYMGEDLPYLGDIERNVSLLLLNRNPVFHKTMPVVPAIVELGYMKKNKSESSLNVEIKKFLDQSKNGVVYFSLGSNIMPSILPQEVIKEIVETFRIIPYDVIFKWDQDTLENKPKNVLLTKWVPQEAVLRHKNTKLFVTQGGLQSSDEAIINQVPIIGIPFFSDQTSNVDTMVKYGMGKVLDYSDLTVEKFSAYIKEVITDPSYKENAKKLSQLYTDQPTDALEKAVWWIEYVIRHKGASHLRSSAMDIPWYQYLMLDIFAFISIILIVIIII

SEQ ID NO: 7374 - protein, 518 aa, Monomorium pharaonis
MRVLSVIFPWLFCLSVCDGYRLLALFPFQGKSHFVMFEQLIKGLARKGHQIDVVSQFPLKKPYPNYTDIVTLPTPLILVNNMTYDLMLEYTRVNPAHIVATIGGNDICNFLRYPAIKELSRPKNPPYDAVLMEVFGAHCFGIIAYLLKVPLIGVSSSSLYPWIPPAIAQPENLAFVPNNLLSVTGSMNFWQRLYNTVHTVYDKWYFDYLTRQDQDKLIRENFGSDMPGVRELERKLSLVLINSQIALNGIQPKTPAAVDVGGLHIQDEDQTIQPELEKWLNDSKNGFIYFSFGSMVIIETFPREFLRILYASLGKIAPVRVLMKIPTPENLPPGLPENIHMSPWMPQIKILKHPNIKAFITHGGLMGAQEAITYGVPMIGIPLFADQFINIDTYVARNIALRLDLETITEKSMDAALNAILWDPLYRETARNLSRQFLDRPLNALDTANYWIEYVIKYGENSLRSPAMDLTWWQLYLIDVIGFLVFCVVFVIVVIVFIVRFMLKIIKNNNSSYSKKIN

SEQ ID NO: 7375 - protein, 502 aa, Tribolium castaneum
MYSLTVAFLFASVSSSRILVIIPTPFYSHQSVFQPLWLELAQKGHQVTAVTANPLKTHLPNLKQIDLSFTYKLVYEDHKMQHVINTESNLLTLMRHVFVVMNNITTEQLNHPQVQELIKSDQEFDLMIVEVHIPAWFGFARKFKCPVIGVTSMDATNHVKRMVGNLNHPVYTHHVNLPFGDGLNFWQRVVCVLFELLDEFQTSYLLYPIQEKIIKNALNDPEINLSEIVKNLTLVFTNIIPGFNKVTTNLPSVVQLNGLQIKPPQVLPLELGQFLDGAAQGVIYFSLGSNVKSYLISEDLQQLLLQVFRDLPFRIVWKFEDEVANLPQNVKVVTWAPQQDILRHKNTKLFVTQGGIQSIEEAIRFKVPLLGFPFFGDQFYNVMRVKKLGIGTWLDFKTLDKEGLKTSILECINNQTYLANLEEIADLLDDPLTSLNRAVWWIEFVLRHRGAQHLRSPLADVPFYQYYLFDVVFFLVFIVFLTSFVLLKLMRRKVGYKKLKVQ

SEQ ID NO: 7376 - protein, 519 aa, Heliothis virescens
MATINYVTLCLTLQLIFYTDAARILAIYPVPSISHQVTFRPITLELVKRGHEVVVITADPMFKKGEAPQNLTEIDVHDLSYNVWQAFMNSERGSRDDLVSQMRVGVEVLLELFDKQMQVEEIKELRKGKQTFDLLLTEAVIRNALGFSHIYKVPVIQVSSFGAMFENYNVIGAPVHPLLYPGSMAMRIYNLTLYEKFNELRTKYTMDYIFASVEEKEANLMKKYFGSDVPPMRELQNNVDMLFLNVNPIWEGSRPVPPSVIHLGGLPQKPNKELPKDLKSYLDSSKHGVIYISFGTNVKPSLLPPEKIQMLVRAFSKMPYNVLWKWDKDVLPGKSDNIRISKWLPQSDLLKHPKLKLFVTQGGLQSTDEAITAGVPLVGVPMLGDQWYNVEKYEHHRIGVKLELGTLTEELFANAVNKVIGDDSYRKNIIKLRDLMNDQPMPPLERGIWWIEHVLRHKGAKHLRSPAANISWSEYLELELVFTVLAIVLSALFILVAALYSLYKFVSKNFVISAKLKST

SEQ ID NO: 7377 - protein, 525 aa, Microplitis demolitor
MAFLRVLFVFTIILSISNYQTHALKILGIFPYPGKSHFVMIGALMKELAHRGHQVDVIGHFPLNKPVENYRDLTIQGSRFLLVNNLTYETTVELNSLALNSVVEILGTGVCDLLSHDVFQKLIKNPQSYDILIIEVNFADCYLAFGQHLNTPVVGVLTGKIDEWLIEPFGIPYNPSFTRSSHSGLTKQKTFFERLENFFLYVFTTSKIKYYMEAETEHVQKYFGRKLNSISDLYKDVSLLLINWHHSLDILPSPPGIVEVAGLHVHDSGQEISSDIKLWLDNSHDGFVYFSFGSMVKLETFPHNILDAFYKMFDRIAPVRVLLKVADIDNMPAGIPKNVKLSTWLPQIAILKHKNIKVFITHGGLMGTQEAITYGVPMVGIPIFRDQFINLHAFEQRKIAIVVKLDELTADSLTNAVNIILHDPTYTENVKKMSSLFLDRPMSPMDTAVYWIEYAARHGNVLKSPGSELSWWQNYFFDIYVFCTICILFIIYIIQMLCKLLLKLLNIRKIKNTSSQSKTRGKKNK

SEQ ID NO: 7378 - protein, 514 aa, Bicyclus anynana
MNTLMKILCIVSLSGSIESARILAVYPVPSISHQVVFRPLMHELAKRGHEVVVITTDPAYPKGKSPQNLIEIDVHDLSYKMWNDFLALGKVQHRMDSEQYNLFMDILLYVFEAQTKSEEVQKLINDKEKGFDLLFVEACVRPALAYGHRYKVPMIEFSSFGGVVGTFDDTGASTNYLWYPLPLREKIHNLAFWEKFLNGYSVYKYNKVPVDREETENKVVRSIFGPNTPSLSELKKNVHLIYLNVNPIWDLNRPVPPNIIYLGGIHQNTDKDLPKDIKTYLDSSKNGVIYMSFGTNARPSLLPVETLNIFTKVFSQLPYDIIWKWDTEDLPNRSKNVKISKWLPQSDLLKHPKVKLFITQGGLQSTDEALTAGVPLIVMPILGDQWFNAEQYVKFKIGIYLRLGSITEADFKNAIETIIQDKTYRENVVKLHNIMRDQPQTPLERAVWWTEYVLRHGGATHLRAAGAHMHWTEYYAVDVVVFIFTVALVIVIGVIFAIRYAMSLKGLKVKIKRN

SEQ ID NO: 7379 - protein, 529 aa, Nasonia vitripennis
MLSTQSKMLTILIVLACSSQSIDGLRILGLFPLHGKSHFVMCERLVKHLAQQGHQLDVYSHFPFKKPIPNHKDFSLNGTLPAVVNNMTYDFFKQFQSVDMAAMMSNVGNPVCELLSTPVFQDLFKSLEKNQPYDLVIIEVFVSNCFLAWGRRLNVPMIGVMTSTLIDWYNEPLGNPFNPAATPGCWSGLFHPMNFWERLINTIMYHMISAQFNYHIKAQNKYVEQHFGHGYPDVTELPRDLDLLLVNTHHSLDGVRAFTPAIIPVGGLHIVDDGEKLPEKVLKWLDESKDGCIYFSFGSMVRIETFPKPILAAIYATFKNIAPVRVLMKIAKPEDLPPGLPSNVMTQSWFSQLQVLKHKNIKAFVTHGGLMSTQESLYAGVPMIGVPLFGDQHLNVRVQARQEIAVFVNHEEITEQSFTAAVKEILNNPIYKKNAESFSKKFFDRPMSPIDTATFWIEYVARHGKNALRSPVVDMPWWQVNLIDVYGFILLVLIIIGYIIKVVVKKILKFCCSSKSEDKRSKKAAKKIQ

SEQ ID NO: 7380 - protein, 510 aa, Galleria mellonella
MKSAVWMLLLCMVAAKVSGYHILGVFPVPSRSHNHLAKGIVDSLLKAGHQVTWVTPYPYDNKNKNLKLVPVGTKVIADALDMTNLNNINQGVNVAKEFARNITTMTANTPAVREAVVKTQYDAVVTEWFFSEIDAGYAAVQQAPWILLGGTVYNSFLERLVDEVRSVPTVPFLMNSAPIPMNLWQRLVNTFFHCMITVTDWLEYLSTCERYNAYFSSLAAARGVPLPPLSEATNNVSILLVNSHPSFAPAQPVPPNVINVAGYHIPEDIPPLPKDLQDLLDSSKHGVVYFSMGSVLKSAALPEHIRRGLIQVLGELPYTVLWKFEEEITGLPKNVHVRPWMPQPSILAHPNVKLFITHGGLLSTMESLQYGIPLLAIPMFGDQPGNAERAIRNGYARKIKYGDDVADQLRVELKEMLNNDRYYKRAKYLSRLFRNRPVPPSKLISHYVELAIETKGAHHLRSPSRQYAWYARWMLDQAALLLVALYLVYRLARALLSLCCGKYKQKIKRN

SEQ ID NO: 7381 - protein, 491 aa, Drosophila sechellia
MVGRTKSYFVIILALTSLIYGAQGANILGLFPSLSPSHLIISMSVAKILAEQGHNVTVVTVLEPTITHKNINLVAVPMTKEEIKQRSETIGAKQKNTSSNRLLSILNMSGQMDSMLRKMADVLKDQRVKELYLNKGNHFDLVISGYFMNDYQFGFARKVNAPVVVLATSPPSQMLNSLIGNPHDKVEKEIGMTFGQRLDSYINSLLYGIFMSQIDQRNRQYFKEIFGDDPTMPEYTDILRNTSLVFFCSHAASEGPIRPSNLEEFLGNATHGAILLSLGSNVQGSHIKPDTVKKIFSVLSNLKQRVIWKWEDLDKTPGKSDNILYSRWLPQDDILAHPSVKLFINHAGKGGITEAQYHGKPMISLPVFGDQPGNAHAMVKSGFGLALSLLTLEEEPFRAAVQEILSNPKYSQQVVKFFSLYRDRPASARDLLIFWTEYVIRHHGAAHLQSPLVHMDFIAANNLGRGYFSWYFINIAESTSNHLRKAKNELK

SEQ ID NO: 7382 - protein, 347 aa, Caenorhabditis remanei
MSFSERLINSISIPIMNTFLPKREFKSFRPPYSFIEMASMEPLSTFIFTNSNSYIDYPRPTLEKNVQIGGISVQIEKLRNMKVDEEWDRILNMRSKTVLISFGSFMLSKDMPLEYKKALARAMATFPEVTFIWKYESDDSTTFSKGIENIHFSKWIPQTALLGVLMLKFPNFLFPFPGDSRLSAFFTHGGLGSVNEVSYLGKPTILCPIFADQMRNAKMLARHNGSIEISKYELADSEKIEEVFRIILFDTSYRLASETLALQLANQPVKPKELLVRHAEFAAQFGRLPSLDPYSRQISFIEYFLIDLAFVGLISLLLSSLVLFLITKRTFSFIRFIFSSAVKLKID

SEQ ID NO: 7383 - protein, 421 aa, Dictyocaulus viviparus
MLLMNSFLFLTCVVQWCNGYKMVLFAPDIANSQVLFNTRIAEKLAKAGHDVTVVILSGDFNEKTDEVIIMNEIKEVLENKKFLNWLPMQKFDLAFSHMIDVCPIGLIHYAKIPSWIWLNSGALMDFVAYYMGVPTIPSYVPPMMMESSDQMNFVERIKSFIGHPLTLLIWKSKLQELQRIVDDALGLVVFSFGSVAPSHMMPSTWKNAFLDAFKRFPNYRFVMAYEGTDLQDRLPSNVHVFKWIPQTDLLAQTKTKAFITHGGYNSIQEAIIAGVPMITIPLFGDQPKNAKMAEKYRIAVNLRKSEVSSENIVNALGNLLNDESYSKNIRRLSTMMKKKPVNAEHLLVAWAEFVAEFRTLDNLVPAGNDLNFFVYHSLDVIAFLITSSTLVFIVLWKFIMFIFRRLCLLCRPKNPKKSKRS

SEQ ID NO: 7384 - protein, 517 aa, Trichinella pseudospiralis
MQITITLYVSICLTYGFISELFAKEFRSNVLHFAFGISKSHVLFNERLANVLSENGYNVHIVFAPVAPGVDLPDFRNNKNVEVIKINFTTTDIFLTLGKQWQKNIFKKDSVRNIFAVGRMFQKLLIDSCKILSKSSALKQQIETIQYDVLLTYCLDICPLAFGWKGKIPKTICISPSTVIFESVASIVGTPIRPSFIPNGGSAYSDKMTFFDRLCNSLLSFLMLMYPQLPISAHKIEENIFKTVHGNDYKSIKELNSNIAGMLINGEASLEFPRPLLPTVIYLGDLLPPKSSQLSTEWQHVVEAENAGIILFSFGSVINANFIPWEIKKELLDAFSRFPNYTIVCKLSVDESHKYHLPPNVKLFNWIPQRELLDHPKLKLFITHGGYNSLLETAKVGVPMITIPLFGDQMSNALRAERKKLSLVINKLEITSENLEKKMKILLEDKTYFDRAKQFAGFIHDKPLSNADMLIRYMDITIRRQKIIKSAVLNLNTIQEFNLDSVILATSAFLVLLSLVR

SEQ ID NO: 7385 - protein, 534 aa, Cavia porcellus
MATALQVPLRGLVRLLLLLVCVMPWTEAGKVLVVPLEGSHWLSMKDVVRQLHARGHQAVVLAPEVSFYLKGEDFFTLKTYTFPYTQEEYNHLFSSQNDFIFETKNALQRMSGIFTALRKFLAGYEQSCVKMLRDNSLMNHLNSSSFDVVLTDPVFPCGAVLAKYLRIPTVFFLRAMPCGLDFEAAQCPSPSSYIPHFFTTYSDHMSFPQRVKNMLHILGWKFICHFIFTPYASIASELFQRDLSVVDILSHASVWLFRADFVLEYPRPIMPNMVFIGGINCISRKPLSQEFEAYVNASGEHGVVVFSLGSMVSEIPEKKAMAIAEGLGKIPQTVLWRYTGTPPSNLAKNTILVKWLPQNDLLGHPKTRAFITHAGSHGVYEGICNGVPMVMMPLFGDQMDNAKRMETRGAGVTLNVLEMTSDDIADALKKVIYDKSYKDNIMRLSSLHKDRPIEPLDLAVFWVEFVMRHKGAPHLRPAAHDLTWYQYHSLDVIGFLLGIVLLVAFISFKCCAYGFRKCFGKKEQRKKTQKSKTH

SEQ ID NO: 7386 - protein, 516 aa, Spodoptera litura
MKILVIIFLNFAVTCKYICGYEILAIFPHSARSHHIYFTPLVEELATKHHNVTVINYHPVQKQPFLRQISLQDRQNASACVDIEKRMQVLSVSDFSLAYATAQVFKNIANTNCQKLMNNREVQDLIRSRAHFDLVIVEQFVTDCGLAVAYKLNAPAIGIAAHILSPWTYSRLGAPNNPAYVPNHFFGSGTKPDLFNRIKSVLINFGMNMYYTHVIQRSDQEIVNAVYPDTPLLEDLGKNMSLIMINQYFTLTSPRLYSSNVVEVGGMHINPNYPIEDKSLINFLDSASNGVVYISFGSVASNFPRRITNEIRKFVEKSNMRFIWKSDITDWVPPSNVFVGKWMPQAAVLCHPKVVGFISHSGMLSTSEAMHCGVPIISVPLFGEQFANGKSAVESGLGVSLDILTLNAQVLEDALQTILKEQYQKKAKELSQLWKDRPLSPMETAVFWIEYVARNKGAVNLKPPTVDMPLYQYLMIDVAFIIASSVVITFYISVKVLSLVLIAVFGKHKLKRKKVD

SEQ ID NO: 7387 - protein, 250 aa, Rattus norvegicus
MCTQEEFEAYVNASGEHGIVVFSLGSMVSEIPEKKAMEIAEALGRIPQTVLWRYTGTRPSNLAKNTILVKWLPQNDLLGHPKARAFITHSGSHGIYEGICNGVPMVMMPLFGDQMDNAKRMETRGAGVTLNVLEMTADDLENALKTVINNKSYKENIMRLSSLHKDRPIEPLDLAVFWVEYVMRHKGAPHLRPAAHDLTWYQYHSLDVIGFLLAIVLTVVFIVYKSCAYGCRKCFGGKGRVKKSHKSKTH

SEQ ID NO: 7388 - protein, 533 aa, Equus asinus
MAVGLRVPLLALAGLLLFLCVGPWAEGGKVLVVPMEGSHWLSMREVVRELHARGHQVVVLSPEVTLHVKKEDFFTMKTYSVSYTQDEFDHLLLGQSHTAFERAHFLKRLWTSMTNLQKASLIFQKFCEELVYNKDLISHLNASSFDVVLTDPVYPCGAVLAAYLKLPAVFFLRHIPCDLDFESAQCPNPSSYVPKLLTMNSDHMTFLQRVKNMLYPLSLKYICHVTLVSYASLASKLLQREMSLVDVLGSASVWLFRGDFVLDYPRPIMPNMVFIGGINCAHRKPLSQEFEAYVNASGEHGIVVFSLGSMVSEIPEKKAMEIADALGKIPQTVLWRYTGTPPPNLSKNTILVKWLPQNDLLGHPKTRAFITHSGSHGVYEGICNGVPMVMMPLFGDQMDNAKRMETRGAGVSLNILEMTSDDLANALKTVINDKSYKENIMRLSSLHKDRPVEPLDLAVFWVEFVMRHKGAPHLRPAAHDLTWYQYHSLDVIGFLLAVVLGVAFIIYKSCAFGFRKFFGKKGRVKKSHKSKTQ

SEQ ID NO: 7389 - protein, 532 aa, Caenorhabditis nigoni
MHCLLTFVFFLFGTVHAKNILIINPIFGYSHAKFISKMADVIADHGHNVTLFQPFHADLKNLDGLVKNKNIEIINYYPDHFEELKNADIQTFPVFWDSHLVNNPVLSSFMMPRMLANEFEKTDKQLYLDTNLHADLKSRKFDVAIAETFGAASFFFAHLLELPCIPMFSAVRFEVINELFGQPLALGYITRDGSKGAPDAGFLDRLNDVYRKYFEVSGFERIFQYQNELFQKTMGRPVPSWKDLISQSPVFITNSNPYLDFAVPTTATVVHVGGITMDLNKMKNVGPLPEEYEKILQERDSTVLISFGSVIRSFQMPDNFKAGLIKMFESLPDVTFIWKYEKDDAEFQKRLPKNVHLKKWVPQPALLADKRLKVFVTHGGLGSTMEIAYTGKPALMVPIFGDQPQNALMLARHGGAVSYDKFDLPDGGKLTRTIKEMIVNPKYQEKAQELLEVLFNQPIDPKLNLMKHLEFAIQFPNLRSQVPEINQVGLIAHYYLDVVLFLALSSTLAFYLLFKILIRISVKLFVKKTKTD

SEQ ID NO: 7390 - protein, 528 aa, Ursus maritimus
MACLLHVFPKAFFLVLWGEVVGDKLLVVPQDGSHWLSMKDIVELLSEKGHDIVVLVPEVNLLLKESKHYARKIYPVPYDQEELQARYRSFGNNHFAERWLLNAAQTEYRNNMIVIDMYFTNCQSLLEDAATLSVLRKSKFDALFTDPALPCGVILAEYLGLPSVYLFRGFPCSLEHTMSRSPNPVSYIPRCYTQFSDRMTFPQRVANYLVNYLETYLFYCLYSKYEDLASNILKRDVHLPTLYRKGSIWLLRYDFVFEYPRPVMPNMVFIGGTNCKKKGVLSQEFEAYVNASGEHGIVVFSLGSMVSEIPEKKAMEIADALGKIPQTVLWRYTGTPPPNLAKNTRLVKWLPQNDLLGHPKTRAFITHSGSHGIYEGICNGVPMVMLPLFGDQMDNAKRMETRGAGVTLNVLEMTSEDLANALKTVINDKSYKENIMRLSSLHKDRPIEPLDLAVFWVEFVMRHKGAPHLRPAAHDLTWYQYHSLDVIGFLLAVVLGAVFIAYKCCVLGCRKCFGKKGRVKKSHKSKAQ

SEQ ID NO: 7391 - protein, 512 aa, Helicoverpa armigera
MLLASVILLLSITGNDAARILAMFPVPSISHQVVFRPLTQELAKRGHEVTVITPDPAFPKGEGPPTLKEIDVHFTYEVWSKMFAVTSTGEQDMIKQMEVAFNLIANIVEIQLKVDEVQRILKEEKFDLLLVEACARPTLVLSHVFKVPVIQVSSYGPLNFNIDTMGMAWHPLLYPLNLNQRLYNLTMMEKLKEVWNVYRLHNLMNEVEVAENDMAKRLFGPNIATIQELKNNVHMLLMNIHPLWEDNRPVPPSVIYMGGVHQKPEKELPADLKTYLDSSKNGVIYVSFGTNVKPSMLPPEKVRILVKVFSELPYDVLWKWDKDELPGRSSNIKIFKWLPQSDLLRHPKVKVFITQGGLQSTDEAITAGVPLIGFPMLGDQWFNVEKYEYHKIGLRLNMNTLTEEQFKSSVEKVVGDISYRKNTERLRSLMHDQPMKSLDNAVWWTEHVLRHGGARHLRSPAANMSWAEYLELELVFTVLSIALSILLLASFILYKLCKYVVGRPLDKKIKAN

SEQ ID NO: 7392 - protein, 530 aa, Microcebus murinus
MAVARESMAGRWMLLLLGSLLPGILLSEVAKILTVSTMGGSHYLLMDRVSEILQDHGHNVTMLHQRGDSFISDFKEEEKSYQVMRWFLPEDHQKELNKRFNFFIEEAFNGRGIYENFLKFIEQFGFQCSHLLSRRDIMDSLKNENFNLVIVDGFDYCHFLIAEKLGKPFVSVLTTSFANVDFGLPSPLSYVPVYNSLLTDHMDFWGRVKNFLTFFTFSRRQWQVQSMYDNTIREHFPEGSRPVLSQLLLKAELWFVNSDFAFDFARPLLPNTIYVGGLIAKPTKPVPQDLENFIARFGNSGFVLVAMGSMVKITSFREILKEMNSAFAHLHQGVIWKCKHSHWPKDANVSTNVKLMDWLPQRDLLAHPSIRLLVTHGGQNSIMEAIQHGVPMVGIPVFGDQPENMVRVEAKKFGVSINLKELKAETLALKMEQVIEDERYKSAAVAASVIRRSHPLTPAQRLVGWIDHILQTGGSAHLKPYAFQQPWHEQYLLDVFAFLLGLSLGAVWLCGKLLGVVSRWLRGARKLKET

SEQ ID NO: 7393 - protein, 514 aa, Ooceraea biroi
MRVQSVIFVSLLWLSDCSAYRFLGVFPFPGRSHFVVPESLMKSLADKGHQVDVISHFPQKKPYPNYTDIAKLATTVIYDNNVTYEFIMQMPNRNMVNTLATFGGNYVCEASLGNPVIQKLVREPPKNPSYDAMIMEIFNAHCFAAIADLLHIPLIGVSTTSMYPWHSELIGQPENLAFVSNVIVRQEFPKTVWQRTYNTLHTLYCKLYFNYLTRPQDELVRKHFGPNLPSIQKMNLALILINTHIALHGIQPMTPAAVQIGGIQIREDDSPLPQELKNWMDDSKDGFVYFTFGSMVLIETFPRTILDVFYVSLGKIAPVRVLIKVPNPEKLPAGLPENIRTFRWMPQVKVLKHPNIRAFVTHGGLMSTMEAIFCGVPMIGMPLYADQFKNVEACVTRNVSVKLDVHKMTEKDMDAALNAILHDPRYMENIRNLSQRVHDQPLRPADIANYWIEYVIKYGDDVLRSPAMDLAWWQICLIDVAACFLFCVTAIITVAMFIICFVMKMINGNHHMFL

SEQ ID NO: 7394 - protein, 524 aa, Bactrocera oleae
MHPRWLLLCLAALLMPITSTAFNILFMGPFPAPSHWLWLEHFLRDLLHRGHHVTALTNHRAKYRHENLTEIIIDPQFDIPHYFPKENIFKMRYASDFQNIQMWFHVGLLTSEYALNDPKVKALIASKDQQFDLIVLEQFFHESFLMFAHKFKCPVVTLGTMGYADNMDHTMGLLTPWAFIPHLLLSHTDQMTFTQRAYNTYLSLYDAVMRRWYYMPKMQEMAERHFTGLVEGPLPHVRQLEKNISLMLINSHRSLDVPRPSMPGLVNVGGVHIKTPKPLPQDLQNYLDNATHGVVYFSLGSYMKSIDMPKEKISLILNAFGQLKQNVLWKFENSSIGHLPPNVKIQSWLPQNDILAHPNIKVFITHGGIFGTQEGIHWGVPMLSIPLYGDQHRNTIKSVRGGYARTLNFGQMTSEDLVQNIRLLISDASYKQKALEASRKFRDNPMHPLDEASFWIEYIARHKGATHLKSYGAYMPLYQYLLLDVFGCALLIAFIVIWLPLKILKFLGSLLRRKEPEALRKKHQ

SEQ ID NO: 7395 - protein, 533 aa, Otolemur garnettii
MVPVLQDLGMRLLGLLLLLSVGPWAEAGKVLVVPMDGSHWLSMREAVRELHARGHQAVVLTPEVNMHIKGEDFFTLKTYTVPHTQEEFDQNFANYIQIVFERQHFLKIFFKSMAVMKDSAVILYRGCRELMYNKTLIGHLNATSFDVVLTDPVYPCGAVLAKYLSIPTVFFLRYIPCDLDFEGTQCPNPSSYIPRLLTRHSDHMTFLQRVRNMLYPLALKYICHVTLSPYASLASEFFQRQVSLVDILSHGSVWLFRVDFVMDYPRPIMPNMVFIGGINCASRKLLSQEFEAYVNASGEHGIVVFSLGSMVSEIPEKKAMEIADALGKIPQTVLWRYTGTRPSNLAKNTILVKWLPQNDLLGHPKTRAFITHAGSHGIYEGICNAVPMVMMPLFGDQMDNAKRMETKGAGVTMNVLDMTSADLENALKAVINDKSYKENIMRLSSLHKDRPMEPLDLAVFWVEFVMRHKGAPHLRPAAHDLTWYQYHSLDVIGFLLATVLTVAFIAFKCCAYGCRKCFGKKGRVKKAHKSKVH

SEQ ID NO: 7396 - protein, 469 aa, Aethina tumida
MHTYQLEMFWYVMCVLQVCESANILGVIPTPSYSHHVSFQPVWRELSLRGHNVTIITANPMNDHELTNLTEIDISNIYECVERYKVWELMSGKNILSDFVEVIFTNPRVQTLIKDPNVKFDLVFYEASAPVCLALAHKYKCPAIGVQSMDTLPTIHTSMGNPTHPLVTPDYILKIEDVENMTFLDRLSAWFCDFFNKILFKIVILPLMNDMNRKYFGDDVPDVNSLMHLTDMIFVTTDPIFHNMRAVNPNTLTIGGGFHIKPPKPLPKVLKQYLDGAKEGVIYFSLGSNVKGNFLNEQSKKAIIGVFSQLPYKVLMKIELENYNVPQNVKIGKWFPQQDILRHPNIKLFITHGGLQSVQEAVTNGVPMVGIPFFGDQYNNIFKGVKKGFAVIVDKENITVESFKEALLEVLTNPKYKETTMKMKEIMYDEPMTSLEKVVWWTEYVFKTQRSKTFQKSYSTYTILSVLFY

SEQ ID NO: 7397 - protein, 512 aa, Helicoverpa armigera
MMSFCLFILVLSVTCNDAARILAVFPVPSISHQVVFRPLTQELAKRGHEVTVITPDPVFTNGEAPANLTEIDVHFTYEDWKKFYETTSGDNNDLLEQLHTAYILIDRIFEIQMKVDKVQEILKEQKFDLLLLEACAKPALALSHIFKVPVIQVSSLGPIFFNSDIVGSAWHPLLYPINFSLKLNNLTKWDKLMELWTLYRIVTMMQQVEKVEDETAKRLFGSDVPPMSELKNNVDMLFVNIHPLWDTNRPVPPSVIYMGGLHQKPQKELPQDLKSYLDSSKNGVVYISFGTNVKPSQLPAEKIQILVKVFSELPYDVLWKWDEDELPGRTSNIRISKWLPQSDLLRHPNIKVFITQGGLQSTDEAITAGVPLIGVPMLGDQWYNVEKYITHEIGVRLNIETLTEEEFKNAITEVIGDKKYRENIKKFGEVVRDEPMPPLERAVWWTEHVLRHGGARHLRSPAANMSWTQFLELELVLTVISVPLGFVLLLSFLLYYSYKHLAISPKQKLKDN

SEQ ID NO: 7398 - protein, 536 aa, Heterocephalus glaber
MTGPLPAFQRVSAGLFFLALWGMVVGDKLLVVPLDGSHWLSMKDILEHLSGRGHDIVVLVPEINLLLKESKHYTRKIYPVSYSQEELEDRFRSFGNLQFAERAYVTAALMEYKNSMVVIDLWFFNCQSLLKDSNTLNFLKDSKFDALFTDPGLPCGVILAEYLQLPSVYLFRGFPCSLEHVLDFAGSQCPNPSSYIPQLLTTYSDHMSFLQRVKNMLYPLALNLFCSTVFGPYPRIASELFQREVSLVDVLSHASLWLFRGDFVLDYPRPIMPNMVFIGGINCVSRKPLSQEFEGYVNASGEHGIVVFSLGSMISDIPEKKAMAIAEGLGKVPQTVLWRYTGTPPSNLAKNTILVKWLPQNDLLGHPKTRAFITHSGSHGIYEGICNGVPMVMMPLFGDQMDNAKRMETRGAGVTLNVLEMTSDDLANALKKVIYDKSYKENILRLSTLHKDRPIEPLDLAVFWVEFVMRHKGAPHLRPAAHDLTWYQYHSLDVIGFLLAITLSVSFITLKCCAYGFRKCFGKKEHVKKTPKSKTH

SEQ ID NO: 7399 - protein, 474 aa, Caenorhabditis brenneri
MDQGRSHATSINTFMHRLQKDNHTTALEFAMFHPDIDFGMEEQFIDMGGFQNPFASPDFDKIAFDEEYSFIHQAVAYGFGSETCNNILSHRRDRFFEILNEGWDLYMSDSLFAVCGYGMAEISGKPHVMMHSTDLEAAQGSLKAFSRNYATFVPSNLPFTMLDFTVSKFQHRVWATYDWFGSFIFTAFVGNFAQKWALRSIIPFPYFSFSEYNRRSSFSFTDMPDSLFPPASRTNDFFSFGAYCKSSHKSLDAEFKTFIEDPKSKGTILIAFGTFVDWRKAPDHYYEAFSTVVNQLTGYRVIWSMKGDRPSGLGKHVKTAAWVPQNQILHHNKTVLFLSHGGLKSTKEAICSATPTIFVPMFGEQTRNAWLIQEKGFGRIMNKFKIDEDVLGTHVNEVLLHPDYQNNANKFLTHYMDQPIPTLDEGAFKFNRLIKYGGKMPSYFYPKALNLSYFTSLNMDLILLPVFFSFLISK

SEQ ID NO: 7400 - protein, 813 aa, Apaloderma vittatum
MAVVLRAHPQLVAMLVLLLSVLSSAAGGKLLVVPVDGSRWLSMREVLDVLSQKGHEIVVVAPEINKHIKPSKNFVMKTYPIPFTKEEVDGSFHSFSQEVFEEGYFLERFLKVYQRLKRISDMTLSTCAHLLSNKQIVRYLQKSKFDAVFTDPVLPCGQILAEHLSVPSIFFFRVMPCGLDFEATQCPNPPSYVPRVFTGLTDHMSFLQRVKNLILDIPNYFLCDSVFQPYAKLASEFLQRDVTVLDLWRKASIWLLRLDFVLDYPRPLMPNMIVIGGVNCAYNKLPQRYQIYTALVLFLSFWSWAEGGKLLVVPQDGSHWLSMRVVLEKLWERGHEIVAVIPDASLLMKSSQSFTIKTYSVPYTQEFLERFYHSIGEKIFDNPSFLEKITIIISNMSEVTTMFSSSCRNLLYDEELMKYIQDSKFDAVMMDPVLPCGPIIAEYLSLPSVYFMRGLPCTLDYEAAQCPSPFSYVPRIFMSSSDHMTFTERVKNHLVGISGNWLCYLFYLKYENLASEFLHKEVTILELFSKASIWLMRYDFVFEYPRPIMPNMVYVGGINCEQKEPLPKEFEAIVNASGEHGIVVFSLGSMVSEIPMKKATEIAEALGTVPQTVLWRYTGQTPPNLPKNVKLVKWLPQNDLLAHPKTRAFITHGGSHGVYEGICNAVPMVLMPLFGDQMDNAKRVESRGAGLTLNILEMTSKDISTALKAVINDKKYKENIKRLSDLHLDRPIHPLDLAVYWVEFVMRHKGAPHLRPAAHDLNWFQYHSLDVIAFLLAVVLLSLFISVKCCMCCCRRCCCKKGRTRKPTKSKSH

SEQ ID NO: 7401 - protein, 525 aa, Drosophila ananassae
MLLLCISLVLFSIGWESAGAAQILGLFAHPGKSHFNFFRPIFTALAERGHNISMYSYFPLEKPIDNYTDYVFQGMPVLTDIVDLQNFESDWKPLGLPFKIPTYFMLHDWGLRSCKVALNSPLIAQLLASPIRFDVVILEHFSNDCMAAVAHLLGAPMIALSSCAIMPWHYKRMGSPFINPIMPMNFLPYTDEMSLIHRINNFFHFHSVSILYNWITQPATDELIKHRFGNGLPPINEIVKNTSLMLINQYYALTGPRPYAPNVVEVGGLQLRVEKPLPQNLMDLLDRSRDGIIYISWGSMVNPNTLSPAKRSALFESISQFKKYNFVMRWKCDPLLLKEKPSNLYIYDWLPQRDLLCHPKVKGFMSHGGLLGTTEAVYCGVSMLVTPFYGDQFLNAGAIEQRKLGIIVDFVNFDTEHITRGLQEILDKQFAENVKRASRAFRLRPIPPLELAVWWIEYVIESGGAPLIQNESRNMHWIVYNSIEVYLICLGVLCLVSIGLWKSVKLLSRALCRVKNEEKFKPKQQ

SEQ ID NO: 7402 - protein, 518 aa, Apis florea
MKFLFAIIVIACAVHDDASGARILMVTPHQAKSHYIVYEALLKRLAERGHQVVSFNHFPQKTVLPNFTDVDISSSMPCVVGTRSIELAFWQTMLQKLKTISFISSETCRSVLEHPEVKKLLHSKEKFDIYIMEIFFSDCFIGISHVLKIPIVVGISSTVSYPWNNEILRNPEIPSYIPNTILSSFSDEMNFFERATNLMYFFISKLAYRYLMDKPGYEIAKKHFGDDLPNLDTLRSRISLILTNGHRTTNTPRALAPGLKELGGMHIPASGPPPLPKHLKDFLDSSEDGVIYFSLGSQINVSTMPNEMLTSFYEAFERVPQRILWKCSERNMPRLPKKVKCIEWAPQLSILCHPNVRLFISHGGMLGSQEAVYCGVPILGIPLYGDQPLNVAYFVKRGLALKLDYHQLSYESTISNALNELLVNNSYTDMARKASFEFRDRPIPPLDEGVYWIEYLLRHGPDSLRTAATNLTWYQYLLLDVILAIIISIVFTVFIVCKLFKLLFWRGKMSIDVNKKRS

SEQ ID NO: 7403 - protein, 452 aa, Papilio xuthus
MLRFSLCLILLVGSTLNIEASRILAIYPCPSISHQIVFRPLTLELLKLGHEMTVVTTDPMFSKENAPANLTEINVHDATYDVIRKIISNVVTGSKSDVLNQAIVVKELIYKATEAILLTNEVQHILKNEKRYDLIFIEALFTPMLGISHKFKAPTILISSFGPFIGSYEIVGAPTKALLYHNMYSQRLNNLTLYEKISELYNYIRIQYIFNHSDEKFNELLKRIFGSDTPTLSELKNYVDMLFVNIHQIWEGNYPVPPTVVHMGGLHQKPQKSLPKDLQQYLDASENGVIYFSFGTNVNISHLPQEKIMIFKNVLSELPYNVLWKIKDDYLPEESKNIKTFQWLPQADLLRHPNVKIFITQGGLQSTDEAITAGVPLIGVPILGDQCYRDNVKRLRTLMQDQPQTPLERAVWWTEYVLRNGGAKHLRAPAANLSWTEWQTSEWPPEIAEIAK

SEQ ID NO: 7404 - protein, 537 aa, Trichogramma pretiosum
MKGFKIIITVLLINFSISRAYRILVIFPFHAKSHDNMLSAFAKGLAERKHQVDVVTHYPLKNPPDTYKVVVNLNGTEPPIINSFHIDYAKTIAEDVTTAVSDRYGSDLCHYMNLPEFQKLIKKIKSSKEKLYDLVVMEVFGSSCYIGFGRLLKVPVVGISTLIEFPWISDFIGNDDNLAYVPSCSSTYFDKTKFWDRLMNFLHYHSQKYRFQSKTEKIQTELMRKYLSPDMPNVREIEKDVALTFVNRHPVIFGVKPLVPSLVELSALHIEKDPKLPADLQKWLDESKSGVVYFTFGSMVLIETLPEHQLLGIYDSLRKLNQRVLLKIADPAKLPPNLPENVLTSPWIPQQAVLKHKNVKLFITHGGLMGSQEALYYGVPMIGIPLFGDQPINVDKFVQMKMSVKIEFDNLTSSSLDWALNEMFTNYEVYKERAEYNSRLFKDRPMSPLDTAEYWIKYVIRYGAGPLKSPALELTWWQLSMLDVYVFLLICFIVANLFLCFFLCNSVNLFLAVVNFIKNRISIKHRTSSRNLSKKIK

SEQ ID NO: 7405 - protein, 544 aa, Anopheles sinensis
MAPATGRFRHTRGQTCSVPLLLLLLPLATLLAVADAAKILAIFPVPLKQHQLVYRPLLEELARRGHDIVLMTTDPLDLPPKGTGNGTLADRIEQIDLGFAYGLPALEQLHVDGLDGRDMLRNIFDVMRTISAEELQHPAVQRLIRSASSAEPGNRFDVVIVEWSGVTLMNAFAEHFRAPLVGIANGGAYINAHEALGNPNHPIGYPSIFMPFSEDLSLLQRISSVLFTVWYRFYYYTEEIPAQNAIAKSNFGEQISDLRQIEQNADLLLINAFQLLGNVRPVGPTTVHLGGIHQRRVAEPLPEDLALFLSHSDGPVVYVNLAVTSAGARLDKIVKTLERLDLASVWALNEDSELINSTGRIYQSYSVPQEAVLAHPKVRVFVTDGGQMNVEDAIQHKVPVVGISYSTSYEHYLRQIAKYEAGIISLIDYESQTFADKLRDVCTDDRYQENVSKLHRLLNDQPQTSIERAVWWIEYVTRNAGAKQLRVRHLSWFEYLMLDVLLAVGVFATVIVCAIAYLIYRAVRYSRSLPMEMVTRGSRKCKML

SEQ ID NO: 7406 - protein, 541 aa, Dufourea novaeangliae
MLVSRLGWIFLCCLVIVTCCTGTINDPKPKKKLKILGVFGHLGKSHFDVFKPLLEELARRGHDLTVVSYFPRTEKAIATEPLPNYKDINLKTKDVDVFVNVVDLQRIRDTYFRVFIELYFLNSMASVACEAGLNHPDVKDLVKSGEQFDVVLTESFNTHCFFAVFHRVDAPFIEISTHQLMSWTVDELGISNEASYIPTLFSHVPRPMNFFQRTWNVVAMMIEWTVANTLFKWNAQSVAEKTHGPGMFDLKEKSRNVTLMFVNTHYTLHGAQPFPPNVIEVGGLHIPRKTNPLPQDIAKFLDDAHEGVLYFNLGSVVKMSTVPEDKLTILLNMFASIPRKVIWKWETDDLPHKPSNLLVKKWLPQFDIMNHPNVKCYFGHGGLLGLSEGVHTGIPMILMPLFGDQYQNAMAARARGVAIVLKYSELNERDLRHAVDEIFNNTRYRENARRLSKAYRDRPATPLETAVWWTEYIGRGNGVPYVRTAGANMSWCTRNLVDVYTFLFTVLLTIIYVLYRLAKYLLLVRKKSKDIDQRASTKKRD

SEQ ID NO: 7407 - protein, 524 aa, Ceratosolen solmsi
MFRIMNIISLTAFLVFILINVIYSESYRILAIFPYNGKSHDIMFNALMMGLAEKNHQIDVITHFPPKNPPPNYKVIVNLNGSLENVQNNLSVDFVTTLSSNTTKLIVSKFGNRICQLLGLEAIQTLVKNPPNNPPYDLVITEAFAANCYMGFGYLLNVPVVLVSSTIEYPWINHYIGNMDNLAIVSYSFLTDFDKLKFWDRLKNVFFYHYDLYIFHTMTEKIQTELMRKFLNPNIPNIREVEKSAALILVNRHPVIYNAKPVTSSLIEVSGLHIKKNNTKLFPELQTWLDEGINGVIYFTFGSMVLIETLPINIITDFYKSFSKLTSIRILMKINDKSKLPEGLPKNVLSYPWIPQQAVLAHKNVRVFITHGGLMGCQEALFYGVPMIGIPLFADQLSNILKFVAKNMAIKINYNNLTMISIDEALYSVLNNPIYRDNAKLYSKIFNDRPMNSMDTAIFWIEYIIRNGPNILKSPALKLYWWQLALLDVYGFILFSLVFIVFFIFCIIKILLAQLYSLKKEKIQ

SEQ ID NO: 7408 - protein, 397 aa, Ancylostoma ceylanicum
MNAIVSLEEYLLFNKRVAEALADAGHDVTIALIVPQSDLDNSDIKIKSAHVVNAPINLTRKAMEERMEEYVFRESDSKMFGRFSLQISMILDTCRATVENKELLPWLKREKFDLAFAHMFDVCTVGLVHAAKIPSWIWLNSGSVIDYVANLVGIPLIPSYVPLEFKASHFRLIADPETELFRTHVSPDFPNLMELAAKCPLVMANTNELYEAARPTLAKVVNIGGIDMLPPNVHLFKWLPQSDLLRHPKTKVFITHGGFNSIQEAIHSGVPVISIPLVGDQPKNAALAEHHGFGVTLSKGEISVESVSQALEEIITNTKYRDAVKRLSKMMDHKPVSPTHLLVKWAEFAAEFQTLENLEPAGNKLNFFQYHSLDIRPTPPLAFWMNSNSSTLRSPDL

SEQ ID NO: 7409 - protein, 226 aa, Heterocephalus glaber
GSMISDIPEKKAMAIAEGLGKVPQTVLWRYTGTPPSNLAKNTILVKWLPQNDLLGHPKTRAFITHSGSHGIYEGICNGVPMVMMPLFGDQMDNAKRMETRGAGVTLNVLEMTSDDLANALKKVIYDKSYKENILRLSTLHKDRPIEPLDLAVFWVEFVMRHKGAPHLRPAAHDLTWYQYHSLDVIGFLLAITLSVSFITLKCCAYGFRKCFGKKEHVKKTPKSKTH

SEQ ID NO: 7410 - protein, 518 aa, Neodiprion lecontei
MGLLGILFALLMTGSFTDGANILAIFPYQGKSHNIMFEPLMIGLAKAGHSVDVVSHFPLENPVTGFNHTSLKGTLRSYVNEVPVEITLKNKGIFRVIHFASAEEPKSLCGLMKLPQLQDIINTDKKYDLMITEIMGTNCYLAVAHKLKLPIVGLVTNVMYSWAYPPVFGDTHPSFIPSQLTEFTNEMNFVERVQNLIIHLYSQYLFSYYDRTLSDPLARKYVEGVPPLNDIYNNISLVICNSHFSIHGARPGNPAVVEAAGIHIDESQILSEELDSFLNSSKDGVVYFSMGTMVRSDTFSPEKIHAIYETFSELSNYKVLWKGNLDSLPEPLPYNVKVVSWAPQYAVLRHPKVKAFVTHGGLMGTQEAIHAGVPMIGIPFFSDQKFNVKGYAHRGFAIYLDYLKISKESFSKALAEVLTNPKYQSNAARFSRLFKDRPLSPLDEAIFWIEYVIRNGGESLKSSGRHLYWFQYYLIDVILFLLAVTSLIIAVLFIFVRRTLRIITGTQTFSDPMKQKTS

SEQ ID NO: 7411 - protein, 520 aa, Leptinotarsa decemlineata
MNPGPVLLLVCLLSSVASSAKILASIFSPSYSHQIVFRPLWRELADRGHHITLLTTDPMRDVSRKNIKEIDLSGSYEVMESFGNSDILSKKRSEGTPKVILEMEILDVLAKVADWQLGVPEVRNLIRNRSEYFDVLIVEALNPIHMAFAERFNVPFIGVSPQEAPIRIYTVLGNYVHPVIFPEPYLPFSPPLNLKQRLASVAFNTITWYYQYHWRYPQETAIARKHFGNIRELQQIEREMSFLFINVNPTLQQTRPVGMNTIYLGGGMHIGEVKPLPEELQDYLDSSGNQGVIYFSLGSNVKSSRLTGNLLDVIVSTFAALPYKILWKFESSLQDLPENVKIINWAPQRDLLADSRIKLFITQCGLQSLEEGIFNEVPMVGMPFMWDQPGNAKTLEKKGLGLTVDIMNLTKDSFTKTIMEVISNPIYKKNVVGLSKLMKDVEKTGLERAVWWTEYCIRTKGAQHFRSGVGEVPSYQMYLLDVILIVVIACIITTLILVMSVVLCYRICFRRSRSLKLKKS

SEQ ID NO: 7412 - protein, 519 aa, Amyelois transitella
MFRLIVIISCVFVIEAARILFVIPTPSISHQLPIRPLSQELAKRGHNVVVITTDPIFTKEEAQNNFTEIDLHDLSYTLWKEKFINAKHSGSVNDLESQISVIYNLTTYIFEMQMEAENVKTLINDRKQKFDLIFLEACARPAILFSHIYKVPVILISSFGPIYNNLEVVGAYDHSILFPEMTRQKINNITDYEKLKEMYNEYKLHKIIDNAEVLQYAVIKRVLGVNAPSLSELYDNVDMLFLNAHPIWDSNRPVPPSVVYLGGIHKTPRKDLPKDLKAYLDSSKHGVIYISYGTNVSPSALPAEKIQMLARVFSRLPYDVLWKWDKDDLPGKPKNVRISKWLPQSDLLRHPKLKVFITQGGLQSTDEAIDAGVPLIGMPMLGDQWFNVENYVKHGIGVRLDMDTLTEEKFQNAIEKVINDQSYRQNIIKLRDLINDQPQSPLERAVWWTEHILRHGGGRHLRSPAANISWTQYYEVELIAYLLAGLLLVLVIFATVIIYTVRFVSQIINSNSKLKSKEL

SEQ ID NO: 7413 - protein, 518 aa, Trichoplusia ni
MVAYLYLLTCYLLFVNSNEAARILAMFPTPSISHQVVFRPVTQELAKRGHDVTVITTDPAFPKGKAPANLTEIDIHDLSYDIWMKSFMSSPRTDDLLTQSEILLNLIRILFDTQLKDERVASLVLGKEQKFDLLILEDCVRPALSLTHFHKVPVILFSSLGFVLDNFQTLGVPYHPLLYPGVPRQRLNNLTLWDKISETYIFMRYQYLIGESIALDDKMLKRHFGPEFPTGTELSNNVDMVFLNVNPIFEGIRPVPPNVVFVGGLHTTPRKDLPADLKSYLDSSKNGVIYISFGTNVDPTLLPAEKIQVLVKAFSQLPYDVLWKWNGDELPGRTENIRISKWLPQSDLLKHPNVKLFITQGGLQSTDEAIVSGVPLLGMPLMVDQWFNVERYVSLKIGLRVDLEDVTEEKFKNAIIEVITNDSYRRNIEKLRSIMHDAPQTPLERAVWWTEYVLRHGGAKHLRSPAANISWVEYLELELVLTLLTGLSVILSVVFIVVRKLYKLIFKSSRSSVKSKRS

SEQ ID NO: 7414 - protein, 530 aa, Chinchilla lanigera
MAPAHSPSPLPLCLCLLLASSFAQAGRLLVVPMDGSHWFTMRSVVEKLVQRGHEVVAVMPEASWQLGQSLNFTVKSYPTSFTVEELDHSFQFFADTQWNTLERGMYSFATGSSKRFFGITFSRCRSLFNAQKIVEYLRKTSFDAVFMDPFDVCGLIIAKYFSLPSVVFARVIFCHLVEEGTQCPYAVSYVPRLFSALPDAMTFKERVQNLFTHLEERLFCNYFYQNALEIAAEILQRPVTMYDLFSQPSVWLLRTDFVFDYPRPVMPNMVFIGGINCHERRPLPQEFEAYVNASGEHGIVVFSLGSMVSEIPEKKAMAIAEGLGKIPQTVLWRYTGTPPSNLAKNTILVKWLPQNDLLGHPKTRAFITHAGSHGIYEGICNGVPMVMMPLFGDQMDNAKRMETRGAGVNLNVLEMTADDLEDALKKVIYDKSYKENIMRLSSLHKDRPIEPLDLAVFWVEFVMRHKGAPHLRPAAHDLTWYQYHSLDVIGFLLAIVLFVAFVAFKCCAYGFRKCFGKKGRGKKAHKSKTH

SEQ ID NO: 7415 - protein, 1099 aa, Apis cerana
MEPFAFRMGWLEENVWERFGVSSPRGLPRLKSRAVVVSQDFVDYRHAIFFCAVYDDASGARILMVTPHQAKSHYIVYEALLKRLAERGHQVVSFNHFPQKTVLPNFTDVDISSSMPYVVGTRSIKVASRQTMLKKLESISLLSLPTCQSVLEHPELKKFLHSKEKFDVYMMEIFLSDCFIGIGHALKIPIVVGISSTVSYPWTNDILRNPEIPSYIPNAVLSDFSDEMNFFQRATNLMYLFISKLAYRYLADRPGYEIAKKYFGDDLPDLDTLRSRMSLILTNGHKAVSTPRALAPGYKELGGMHIPASGPPPLPKDLKDFLDSSENGVIYFSLGSQINMSTMPNEVLMSFYEAFERIPQRILWKCTENNMPRLPKKVKCIEWAPQLSILCDPNVRLFISHGGMLGSQEAVYCGVPILGIPLYGDQHLNVAYFVKRGFALKLDYHQLSYESTISNALNELLLNKSYRDMARKASFEFRDRPIPPLDEGVYWIEYLLRHGPDSLRTTAPNLTWLKIDAGGKKIVEEVSTMVPKLFERYTRHGALPIRQDDCSYVWQIPAENRCNWVRETRDCRTDSLIQYTEILFCTFTSENKPLFVFGLMLMVIWLLYLFFILGTSADNFFCPSLAVIASVLRLSDNIAGVTILAFGNGAPDIFTSLVSGADESIIMFTELIGAGVFVTTIIAGSVSVVRPFRVELKFMMRDACFYIMTVLWISFVVRDHRVHLWEAAKRIPSVPDEDILRTYLVNKEDDTIPEIPIKSRAAGLRAKLDVAIAVELQRLRKKEEKPIIEEVGRPKGLFREFFYDINPISKEDWQDANAFIKFILIIRAPFMCILQLLIPLVSVTTVKRGWSKLLNCFQLCVTPTFALFVLNVTTAISFSSSFPVWAVRIGPITLAPIFLLIGTIFGIIVFLITDKDHIPKFHNAFAFFGFFTAMMVVYLVAKEVMAVLQCVGYAFSISDAMLGITLLAWGNSIGDLIANVTIAKQGFPRMGYAACFGGPMFNTLLGLGLTYGLEAAKDPNYLTMMRLSDMAPGCLAFLVCSLFMSIIYLNITGAIARKSYGFLLYSIYFSFLLIQFLSELHIIHPLGIDHRPDIDPKGQ

SEQ ID NO: 7416 - protein, 541 aa, Acyrthosiphon pisum
MRTTKMDYRLQLVTLLLALGCCRGLPNNTRPYNILVFLPTETKSHFMGFQPLLETLVTRGHNVTLVSPFALGSGGTALTYYTHVKVEITENVAGPVNFLDRNSLMNRLPLYMYTLWLGPMITKTAVDKKSVRDFVLGDRSAFDVVVVENFFHECFVTLGHKYGVPVVQLLPFAANPRVSQWHGNPYGPAYIADFASDFVAPMTFAQRAQNAVATLFNTWVNRLLYMPMQRAIMDEHFAYAGHEGRPDLETMLRNVSLTLVNSHPMIGPAAPYVPSYVQVAGMHMKPAGPLPTDLKTILDSAEHGVIYFSLGSVVKSSKMPQETVSLLLSELAKLKQTVLWKWEDDQLPNLPKNVMVKKWFPQNDILGHPNCRLFITHGGILSLIEAVYHGVPMLSIPVFGDQAHNSIEAQSRGFALYVPFFELTAENFGSKLQQLLRDPGFGEAAAKASSIIRDNPTSIMDKAIFWIEFVVRHGGAPHLRTVANQLYWFQYYMLDVIAAAMALLAVVSYLNFKCLAYLLKKIFGGSKRPASKVSKIKKKRQ

SEQ ID NO: 7417 - protein, 535 aa, Diuraphis noxia
MDYRLLLVTLMIAVCCCCGLPNITRPYNILVFLPTETKSHFIGFKPLLETLVTRGHNVTLVSPFGLGSGGTPLPKYTHVKVEITENVAAMDFLDRNSLINRLPLYMVQLWLGPMITKNAVDKKSVRDFVLGDQSTFDVVVVENFFHECFVTLGHKYGVPVVQLLPFASNPRVSQWHGNPYGLAYMADFVAGYVAPMTFPQRVQNAVAALFNTWVNRLLYMPQQRAIMDEHFAYAGHEDRPDLDMMLRNVSLTLVNSHPLIGPAAPYVPSYIQVAGMHMKPAGPLPMDLKIILDSAKHGVIYFSLGSVVKSSKMPREIVSFLLSELAKLKQMVLWKWEDDQLPDLPKNVMVKKWFPQNDILGHPNCRLFITHGGILSLIEAIYHGVPMLSIPVFGDQTHNSIEAESRGFALYVSYFELTAEIFGSKLRQILRDPRYGEAVAKASSIMRDNPTSTIDKAVFWIEFVVRHGGAPHLRTVANQLYWFQYYMLDVIAATMAALAVVSYLNFKCLSYLLKKISGGSKRSASKVSKLNKKKQ

SEQ ID NO: 7418 - protein, 534 aa, Ooceraea biroi
MKTKMRMLPVIFVWLFWLPICAAYRFLGVFPIAFKSHFVILESVMKGLISKGHQVDIISPFPQKTPYPNYTDIANLTAPLSFVNNFTYEHMTQIVADNNPAILIGLINGNDICEAHLGNPVIQNLVRNPPKDPPYDAMIIEVFGAHCFAAIAELLNIPLIGLSTTPLLPWHNELIAQPENLAFVSNLFANKESPTNLWQRTYNTLYNLYCKLYFTYLTRPQDELVRKYFGPNLPSIQKMNLALVLINSHIVLNGIQPMTPAAVQIAGIHIRDDESPLPQELKKWMDDSKDGFVYFTFGSMVLIETFPRKILDVFYASLGKIAPVRVLMKVPNPEKLPAGLPENIRTFRWMPQVKVLKHPNIRAFVTHGGLMSTLEAVFLGVPMIGIPLYSDQFKNMETYVTRNIAMKLDIHKISEEDMSAALNAILHDPRYMENIRNLSQRLLDQPLNPVDTANYWIEYVIKYGDDVLRSPAMALAWWQICLIDVAACLLLCAAAIITFAMFIMRFVVKMINEKHHLLLYLKKIGSIEPIRGKF

SEQ ID NO: 7419 - protein, 531 aa, Bicyclus anynana
MLFHNINVVAAVLSALLLLAGYTESANILHVIPFSAMSHYIFLRHIGLELAQRGHNVTVITTHKEKNPPSNYHQVQVQKKQIWELIGGERPNIFDMAELSSEEFHHKVVWPGGLAFTELTLNSSDVQEFLKKDNTFDLVICEQFVQEALYTLASKYNAPLVIISTFGNCMRHNIMTRNPLQLATVLAEYLKLNNPGNFWGRLRNLYFTVYEYLWWRYWYLEKQEDLVKKYLPDLIGKTPSLYEMQKNASLMLINSHFSFDTPTAYLPNIVEIGGMHVRKSNKSLPEDLQKLLDESKHGVVYMSFGSNIRSAELPEHKKKAFLNVFKELKQTVLWKWEEDVLEGKPKNLFTGKWLPQQEIIAHPNIKLFITHGGLIGMQEAIYNGVPIVGVPIFSDQYNNVLLAEEVGVGKLLHYNDFNEDTLNKTINEILNNDSYLKTAREVQKRWNDRPMSPLDTTIFWLEYVIRNKGAEYMKNPARNMSWFEYTMLDVYAFILLIIVAVLAFFVKLILIVRAIVYGKQTNKMTKRKKRL

SEQ ID NO: 7420 - protein, 1044 aa, Pieris rapae
MSPSNTLLIFLIGITSNNAARILGIFPTPAISHQGAFRPIIHELARRGHQVTVLTTDPAFPKDKPLPNLTEIDVHELSYADKDEWLEKSENSKEGFFKELKKIFERITILLELQIQVPEFKELYKEKFDLLLIEAYVRPLLGLGHVFNVPVIQISSLGGGPFTYSSFGAPSHPLLYHSVISQRLYNLTLIEKAQELFKNYFVEYLLAQTEEFDYEMMKRNFGEDVPNFEELQKNVQLLLLNEHPIWANNRPVPPNIIFVGGIHQPQEQELSKELKHVLDSSKNGVIYVSFGTSVKASVLPPERIGAMVKVLSQLPYDVLWKWDKDDIPGKGKNIKLFKWFPQSSLLKHPNVKLFITQGGLQSTDEGINAAVPLLGIPMLGDQWYNVEKYVHHKIGLQLDIYQLTEENFRNAIESLIGDKSYKENIVKLRSLMREHPVGPLELAMWGIEHILKYGGSHLKSPAAGMSLMEYYEVPLLLAATAILITAIAVMIFTAIFIWRMVKCCFKSRVTKKKIKSNLKQVSDNRLSNFTMYRLTILVLSCVVTVANTAKILAVLPTPSVSHQVVFRPLMQELARRGHDLTIITADPIYTAGNAPKNYTEIDVHDISYKIWMDAFTHGVRFGKKDDMFAQMRSFTVINPSVAIAQFKEKQIQDLYKRKEKFDLIFIEAWETQGYYYSHIFKAPVILISSFGMFGNEDAAVGAMTHPFLFPKLVQQRTYNLTFWEKAKELYRNYWFRKLWSTMEENDRDLWGQLLGEEVPDFKEINNNIDMMFINVHPLWISNQPLPPNIITIWGIYRNQRKPLPTDLQNYLDSSKHGVIYLSFGSNAHSSVLPPEWIQLLVRVFSRLKYDVLWKWEKPELPGKSENIKISKWLPQSDLLRHPNVKLFITQGGLQSTDEAITAGVPTLGMPMLGDQWYNLEKHVHFKIGKKLEMETLTEEELETAIHTVINDPSYKENILKLRTLMEDQPESALDRAVWWTEYVLRHGGAKHLRSANANMSWVEFYEVEFVLKAASLLLLLLVLGVAFLYYTYITFVTKQKLKTH

SEQ ID NO: 7421 - protein, 520 aa, Trichoplusia ni
MRVLLYFVTCFILFINFNEAARILVVIPTPSISHQVVFRPVVQELAKRGHDVTIITTDPAFPKGGTPGNLTEIDVHDISYRVWREHFMKASKTDGGDLYNQLNTIVTVGLRVFVEQFNDANVQRLIKDKNQKFDLIITEALSRTALGYQHIYKAPLILMSSFGATFDNFEALGLPTHPLLYPTIIRQRINDLTMMEKISEVYTSFRLYNMFSNFLVEEEKTMKKLYGPDVPSVNEFYNRIEMLFLNENPVFTGIRPVPPNVIYMGGLHQNPLKELPKDLKLYLDSSKNGVIYISFGTNVDPTQLPADRIQALVEAVSQLPYDVLWKWNGDELPGRTENIRISKWLPQSDLLRHPKIKVFVTQGGLQSTDEAITAGVPLIGIPLLADQWFNVERYVTHGIGVRLDIATLTAESFKNTLLKVIEDDSYPQNTVKLRTLMRDQPLTPLERTIWWIEHVLRHGGAKHLRSPAANISWAEYLELELVLTLLAGLLAAISVVVLSIYWLFKYFVGYNVLNSKVKRS

SEQ ID NO: 7422 - protein, 468 aa, Caenorhabditis remanei
MKYVIFLLTIFPLSLSYNFLVFCPLFGHSHTTFFAKIADTLSDAGHNVTFFTPTVTRKYTKINYVRSTKNVIHLEPSEKLALIGDKFQMSDPSKFWKQDSSIYEILPMIDTFFEMFVELTKVLEENLELLDKLKEENFDVMIFENIVPPAYSVLDYLQIETFIPSTSIAFDNSLLYSIGEPFMPSAIPFPISEFSDRMSFSERLVNSISIPIMNTFLPKREFKSFRPPYSFIKMASLEPLSSFIFTNSNPYIDYPRPTLEKNVQIGGISVDIEKLRNVKVDEKWDRILNMRSKTVLISFGSFMLSKDMPLEYKKALARAMATFPEVAFIWKYESDDTTSFAQGIKNIRFPKWIPQTALLADSRLSAFFTHGGLGSVNEVSYLGKPTTLVNLESTVSSFVPSQFQCPIFADQMRNAKMLTRHNGSIVISKYELADSNKIEEVLRIILFDKSTVLTSSIPGSILSTHVIH

SEQ ID NO: 7423 - protein, 521 aa, Fopius arisanus
MTFLRALLLLGGVLILQTQGTSALRVLGVFPLPGKSHFILAENLLKEMARRGHSVDMVSHFPTKNPIPNYRDISLRGSLPIAVNNISFEETRTFSGFSMAFFVRHTGTQICELLGTPYLEELLRTPKGTYDVIIVELFTAQCYIALGKHLDAPVVGLVASKMHDWLFDPFANPLNPSYMPSLFSSFSQRMTFWERLTNTFVMNVIGLQINYYLNEQIEYVEKNFNRRISSINDLYNDVSLLLVNEHFSINEIKPATPDVIDVGGLHVHDDDQMVTPELEKWLDASTEGCVYFTFGSMIRIETLPPEKLKILYETFEKIAPVRVLMKIADPKILPKGLPKNVMTSSWMPQVAVLKHKNVRAFITHGGLLGTQEALAHKVPMIGIPLFGDQHTNIRTYQNKNIAIALSIDTLSVDGLTNAIIAVLNDPKYRKNIAHISDLFLSRPMSALDTAVYWVEYTARHGTVMKSPATELSWWQLYLLDVYGFIITCALIILYVLKKIVTTVWSCCKRNQTPISKSKKNR

SEQ ID NO: 7424 - protein, 530 aa, Sus scrofa
MAPVVLTRFLPLCVCLLLSPGFAEAGKLLVVPMDGSHWFTMRSVVEKLIHRGHEVVLVTPEVSWQLTNSFNMTVKTYSTTYTLEDLNREFQIFSDFQWKARQMSMFSMLMSESTKFFDYFFSHCGSLFNDTKLVKYIEESSFDAVFLDPFDMCGLIVAKYFSLPAVVFTRGPFCHHLEESTQCPMPLSYVPRELSAFSDVMTFGERLRNHIWHLEERLFCHYFVKRALEIASEIFQTKVTAYDLYSQASVWLLRTDFVLDYPKPVMPNMIFIGGINCHEGKPLPKEFEAYVNASGEHGIVVFSLGSMVSEIPEQKAMEIADALGKIPQTVLWRYTGPAPPNLAKNTKLVKWLPQNDLLGHPKARAFITHSGSHGIYEGICNGVPMVMMPLFGDQMDNAKRMETRGAGVTLNVLEMTSKDLENALNTVIKDKSYKENIMRLSSLHKDRPIEPLDLAVFWVEFVMRHKGAPHLRPAAHDLTWYQYHSLDVIGFLLAVGLTVVFIAFKCCVFAYRKCFGKKGRVKKSHKSKTH

SEQ ID NO: 7425 - protein, 531 aa, Pteropus vampyrus
  MOD_RES (56)..(56): Any amino acid
MAAGSQGPRLLVLGLLLCVRGLSVSQGRKLLLVPLDGSHWLSMHGVIRQPHQRGYXVLASVTSVYITEGAFYTLKRYPAPFKREDLEASFISLGRAVFENQPFLQRVVKTYKKVKKDSALLLSICSHLLHNKELMTSLAEGNFDAVLTDPFLPCGPIVAQYLALPAVFFSSALPCSLDFQGTQCPNPPSYVPRLLSFNTDGMTFLQRVENMLVALLENFLCSAVYSPYASLASEVLQKDVTVQDLLSSASIWLLRSDFVKNYPRPIMPNIVFIGGINCASQKPLSQEFEAYINASGEHGIVVFSLGSMVSEIPEKKAMQIADALGTIPQTVLWRYTGPRPSNLAKNTILVKWLPQNDLLGHPMTRAFITHSGSHGIYEGICNGVPMVMMPLFGDQMDNAKRMETRGAGVTLNVLEMTSEDLANALKTVISDKSYKENIMRLSSLHKDRPVEPLDLAVFWVEFVMRHKGAKHLRPAAHDLNWYQYHSLDVIGFLLAVMLGVVFIVYKCCVFGYRKCFGKKERAKKSHKSKVQ

SEQ ID NO: 7426 - protein, 518 aa, Acyrthosiphon pisum
MSHKSMISIVIFTLVSCTCIQSGNTARILAIETFAGKSHWNFMSSVLRAMTDNGHNVTVFTPFLDGNRENYTEIDMSNIFPMKLNMSLVRMRNIFNNWFTPISFMMKNDGRRSCEILHNNDQLNDFLENKLQTDFDAIVIEPGIVSGCLSYLGANSNLPVIYTTPIPINTYTERITYGDVSNPATVSPMLFNFAVPKTFNQRFTNTLIWLYSSIIVKFQEFLLQLFDSKPYDLGTINPPSLVFMNTHFISDKSRPTPSNVVNVGGIHLKPYKKIPKDILDFIEDSPHGVILFTFGSTTAMSSIPKYILTAFREALAELPQKVLLKYEGEMEDKPKNVMTRKWFPQRDILLHKNVKVFISHGGISGLYEAVDGGVPVLGFPLFGDQYRNIDNLVEAGMGISMEIYAVTKDTFLKNLLDLVNDEKYIKNAKITSEIFKDRPISPEKSVAYWTEYVIRHKGAPHLKSQALNLTWYQYFLLDIIAVILIFILIFILIVLKFFKFIHTIYYKICSSLSKVKSD

SEQ ID NO: 7427 - protein, 518 aa, Spodoptera litura
MVGFRKILLCIALQVIFADAARILAVFPVPSFSHQITFRPITMELIKRGHEVVVMTPDPMFKKGETPANLTEIDVHDISYQASQVFMEAAKGKKEDLITQMKVASEMLIDVVDLQYQTKEMKDIIKGKQHFDLLLVEACIRPALAFSHVYKVPLIQISSFGAIFDNYAVIGAPLHPFLYPSSMNQRIYNLTIYEKLYELYNNYMIDQMSNGMAVEEYKMLKKHFGPDVPEIKELQNRVEMMFLNVNPIWEGIRPVPPSVIHLGGLPQKPHKELPQDLKSYLDSSKNGVIYISFGTNVKPSLLPPEKIQTLVKAFSKMPYDVLWKWDKDELPGRTANIRISKWLPQSDLLKHPKIKLFVTQGGLQSTDEAITAGVPLVGVPMLGDQWYNVEKYVHHGIGVKLELISLTEETFSTAVNTVIGNESYRKNIQKLRTLMTDQPMKPLDRGIWWIEHVLRHGGAKHLRSPVANISWAEYLEFELIAIVLSALLAALAIAIAVVYSLYGFVTRNYIIKAKVKSS

SEQ ID NO: 7428 - protein, 519 aa, Ceratitis capitata
MSKSTPSHLLFLLGLCCTLVQASYPLKILGLFPHPGISHFHFFHPIMRGLAEKGHDVTVISHFPDKSPPARYKDLPLTNLETLSDSVDLKFFENRRFYNHFVEFFLLYEWGRSACNTTLRSDALAQVLRQRQRFDVVIMEQFTSDCMAAVAHQLKAPFIGLSSCALMPWHYGRMGMPMIPSHMPALFMGQAESMTFSARLANWFTFHAMRLLYDFYTTPSTDALVQYKFGHDIPSVGELAKETSLMFVNQHFSLTGVKPLPPSVIELGGVHIQKAKPLDPELQKFIDNADHGVVLISWGSMVRANTLPPAKRDAILRAIKRLKQRVIWKWENGTLEHKPDNLYVSKWLPQRDILCHPNVKVFMAHGGLMGTSEAAYCGVPMVATPFYGDQFVNSAAVKYRRMGVVLHYEDITENSVLRSIREVLKKEYMDNAKAVSFSYRHRPQSALETAIWWVEYVAKTEGAPLTKGHAVSLSGFVYYSLDIYLFLAFVAVISVLSWRFVWNRICARRPKAPVKQKTN

SEQ ID NO: 7429 - protein, 532 aa, Gallus gallus
MALVLPSHPQVSVSLLLLLSVLGLAAGGKLLVVPIDGSHWLSMREVLDELRQKGHEIVVVAPEVSLYIKPSENFIMKMYPVPFTQEEVDGMFRRTGQDAFMEGSFLERFIKAYQGVKNSSAMFLSTCEQLLYNKELIRYLQENKFDAVFTDPILPCGQILAEHLSVPSVFYLQQIPCGLEFEATQCPNPPSYIPRIFTDNTDHMNFLQRVENVIFSISNFFLCDVVFQPYAKLASEFLQHDVTVPGLLSKASIWLIKLDFVLHYPRPLMPNMIMVSGVNCAHKKLTQEFEAIVNASGEHGIVVFSLGSMVSEIPMKKAMEIADALGSVPQTVLWRYTGEVPPNLPKNVKLVKWLPQNDLLAHPKTRAFITHGGSHGVYEGICNAVPMVLMPLFGDQMDNAKRVESRGAGLTLNILEMTSKDISDALKAVINDKKYKENIQRLSDLHLDRPIHPLDLAVHWVEFVMRHKGAPHLRPAAHDLNWIQYHSLDVFAFLLAVVLLSLFISVKCCMFCCRRCCFKKGRKSKSGKSKTH

SEQ ID NO: 7430 - protein, 289 aa, Oesophagostomum dentatum
MYFSSPLVDHVAQKVGVPTIPSYVPPMPMESHDTMTFYKRTKSFLGHVLTYLFWDRIIVNPEVELFRELVDPAFPHLNDLAKKCPLVMVNSNELYELPRPTLAKVINIGGLGIQLQQSKPLPEEIENIIARGEGAVVFSFGSLTPARRMPESWKEAFFKAFKRFPHIQFFVKYDGDDVNEMLSKNVHLMNWLPQMDLLYHPKTKAFITHAGYNSVQEAIHAGVPMICLALFGDQPKNAKVTEKLGISVNLKKTAISEEAVVAALQEVLNNERYRLKALKFFFINNRFGF

SEQ ID NO: 7431 - protein, 496 aa, Caenorhabditis brenneri
MADVIADHGHNVTLFQPFHNAMKNTEGLVKNKNVEIINYYPDHFDELVNLPTETFPLFWDSQLMNNPILQAFMMPRALAGQFERTAVQLLKDQKTLDELKSRNFDVMIVETFEITGFYVAQLLNLPFIPTMSGVRFPCFNDLFGQPSGLGYYPWIDSKLAPEAGFFDRLNDLYRNFFMYRMMDGMGDLQYAYIEKAIGKPVPYWKDLIKESPIYITNSNPYLDFAVPTTAVIVHAGGMTIDLKKMKHVGKLPEEYEPILNERESTVLISFGSVIRSFQMPENFKAGLIKMFESLPEVTFIWKYEQDDEEFQKRLPKNVHLKKWVPQPALLADKRVKVFVTHGGLGSTMEVAYSGKPALMVPIFGDQPQNAYMLERHGGAIAYDKFDLKDGEKLTKTMKDMVENPKYEENARELFKILSNQPIDPKMNLMKHLEFAMEFPKLRAQVPAINHANFIAHYYIDALAFVALAGVLIVYSTVKILRRILPIKLVSTKSKAE

SEQ ID NO: 7432 - protein, 521 aa, Papilio xuthus
MLFKGLYILLLSFTIVSVKSANILAYFPCPSISHQVVFRPITLELIKRGHTVTVITTDPIFPKGEAPANLTEIDLHDASYSLLLKNVPKFILGRRSDFVHQIHLLKDFIPKMIEEQMNVSEVKELLNDKSKKFDLILVEAFYLMALGITHVFKAPTVLISSFGAFIGSYEIVGAPTNPPLLYRNIFSQRLYNMTVWDKLNELYTQLNIRYAMTDLEIEENKALKKIFGPDAPTLTELKNNVQMLFVNINPIWEDNYPVPPSVVHMGGLHQKPQKELPKDLAQLMDESKNGVVYFSFGTNVRPSALDAAKLDVFHKAFAKLPYTVIWKWDDESLLPKSNNVKIFKWLPQADLLRHPNLKLFITQGGLQSTDEAITAGVPLLGIPMLGDQWYNVEKYVYHKIGVGLDFENLTEEQLKQTILEVAENDSYRKNIERLRSLMEDQPQKPLERAIWWLEHILRHGGAKHLRSPAANISWSEYLEIELVSLILTILVTSLLIVILVTRYIFRKILQLYRIYNKEKVL

SEQ ID NO: 7433 - protein, 504 aa, Lucilia cuprina
MSFKLNTTLLLLIFAGSYQSTQAAEILALFINGHQSHLLVYASVVNLLLQRGHQVTVVTTLDVADIIDVQNIRWLKLSENYTETVITTGSKRMNSFNKLERMFNRIENTSKFMKDPQWVSFLNEDNNYDLLILGYLFNDYQLGVSAHFKCPVVLIWTSQPIGFVQSLMGNPEERWYVSQPYDSHQYNGVKAIAFGWFEKFVELLALDRMQEIYTKYFPANHYPSFKEIRKTVSLVLCNHHSLSEGPIAPFLPSIIEIGGIENKFVSQRNQMNLSDFITSKQKIIYFSFGSRVKWSLLPESLEQIFIETFKVFSNYTVLWTYDKNCTKLEMQFPFSNVKCQAWWPQSSILNYPQTKLFITHGGKGSITESQLYGVPMLGIPFFGDQKVNVYKMVDKGFGLKLDLRNITYKNVVVNIKQILDYTKYVNNIKIFSELYHDRPISNEQNAAYWLEYVLRYKGAKHLKSPVLQLNFFQYYLLDVYTLILVGFLTIVSILNILERKIMQQ

SEQ ID NO: 7434 - protein, 353 aa, Fopius arisanus
MTFLRALLLLGGVLILQTQGTSALRVLGVFPLPGKSHFILAENLLKEMARRGHSVDMVSHFPTKNPIPNYRDISLRGSLPIAVNNISFEETRTFSGFSMAFFVRHTGTQICELLGTPYLEELLRTPKGTYDVIIVELFTAQCYIALGKHLDAPVVGLVASKMHDWLFDPFANPLNPSYMPSLFSSFSQRMTFWERLTNTFVMNVISLQINYYLNEQIEYVEKNFNRRISSINDLYNDVSLLLVNEHFSINEIKPATPDVIDVGGLHVHDDDQMVTPELEKWLDASTEGCVYFTFGSMIRIETLPPEKLKILYETFEKIAPVRVLMKIADPKILPKGLPKNVMTSSWMPQVAVL

SEQ ID NO: 7435 - protein, 533 aa, Elephantulus edwardii
MAVGVWILPWVVRALPLLLCVGPSAEGGKVLVVPMEGSHWLSMKKAVQELYARGHQAVVLAPEANLLIKEEDFFTLKTYAFPYTQEQLEENFLQHSHQIFVPEHFLKTFFRALENLQNMVSMHQKSCSDLMYNKDLIKYLNESSFDAVLTDPVNPCGAVLAQYLSIPAVYFLRFIPCELDFAATQCPNPPSYIPRFLTRNSDHMTFLQRVKNMLYPLALKYMCYVSYAPYASLASELLQREVSVTDMFSYGSVWLFRGDFVMDYPRPVMPNTVFIGGINCVSREPLSQEFEAYVNASGEHGIVVFSLGSMVSEIPEQKAREIADALGKIPQTVLWRYTGTRPSNLAKNTILVKWLPQNDLLGHPKTRAFITHSGSHGIYEGICNGVPMVMMPLFGDQMDNAKRMETRGAGITLNVLEMTSDDLANALKAVINDKSYKENIMRLSSLHKDRPMEPLDLAVFWVEFVMRHKGAPHLRPAAHDLTWYQYHSLDVIGFLLAIVLVSTFITFKCCAFGCRKCFGKKGRVKKTHKSKTH

SEQ ID NO: 7436 - protein, 534 aa, Sus scrofa
MAMGFQAPLPMLAGLLLCLCVVVPWAEGGKVLVVPMEGSHWLSMRKAVQELHARGHQAVVLSPEVNMHIKAEDFFTVKSYATPYTQDEFDDLMVRHLHLLFEKANFLTMFWTTMVSLKKVFLMFERSCEELLNNKDLIRDLNASSFDVVLTDPVYPCGAVLAKYLSIPAVFFLRSLPCDIDFEGTACPNPFSYVPRLLTMNSDHMTFFQRVKNMLYPLALKYICHVFVTPYAQMASKLLQREVSLVDVLSSASVWLFRGDFVMDYPRPVMPNMVFIGGINCANRKPLSQEFEAYVNASGEHGIVVFSLGSMVSEIPEQKAMEIADALGKIPQTVLWRYTGPAPPNLAKNTKLVKWLPQNDLLGHPKARAFITHSGSHGIYEGICNGVPMVMMPLFGDQMDNAKRMETRGAGVTLNVLEMTSKDLENALNTVIKDKSYKENIMRLSSLHKDRPIEPLDLAVFWVEFVMRHKGAPHLRPAAHDLTWYQYHSLDVIGFLLAVGLTVVFIAFKCCVFAYRKCFGKKGRVKKSHKSKTH

SEQ ID NO: 7437 - protein, 520 aa, Acyrthosiphon pisum
MDYIVRSLYLLTVFLIFSTFRGPWMQPAESANILAIETIAGKSHWNFFSSVLRSLTDKGHHVTVFTPITEGNRENYTEIDTSGDLPKKREIGLTDMMKVFGDPIKTLWFGPGIARSYCDIIHGNERLKDILEGFVHTDFDVILIEPVWLDCMSYVATKLNLPMIYLVPQSMVTFLEYSYLGHVPNPASVSNFMADHGVPKTFVQRFTNTALLSYSLLTFSCFEFLLKYREPKPYDVLRPVRPSVMFVNSHYITEASRPFFSNFVSVGGIHLNAVQNIPNDILEFIENSPHGVIYFTFGSVVSMSTLPDHIQNAFKEAFAQVPLRVLWKYEGEMKDKPINVMTSKWFPQRDILMHPNVKLFISHGGISGVYEAVDAGVPVLGFPLFYDQPRNIDNLVEAGMGISMDLLTLQKDELLTNILELINNEKYMKNAKIVSDRFKDRPMSPAESVVYWTEYVIRHKGAPHLKSHAFNLTWYQYFLLDVIFVIFIFISFVIFIIYKLFKTIYYYFLKYSQTIKPKLQ

SEQ ID NO: 7438 - protein, 533 aa, Myotis brandtii
MATGLQLPPPLLMGLLLFLCVGPWTEGGKVLVVPMEGSHWLSMREVVKELHARGHQAVVLSPEATLHVKEEDYFTLKTYAIPFTQEEFQYLMLGHIDLVFERAHFLKTFLNSIVILKNVSSVYQKSCEELVHNQDLIRHLNASAFDVVLTDPVYPCGAVLAQYLSLPAVFFLRAIPCDFDSEGTQCPNPSSYIPRLLTRNSDHMTFLQRVKNMLYPLALKYICHVSLSPYARLASELLQREMSLVDVFGYASVWLFRGDFVLDYPRPIMPNMVFIGGINCANRKPLSQEFEAYVNASGEHGIVVFSLGSMVSDIPEKKAMEIADALGKIPQTVLWRYTGTRPSNLAKNTILVNWLPQNDLLGHPKTRAFITHSGSHGIYEGICNGVPMVMMPLFGDQMDNAKRMETRGAGVSLNVLEMTSEDLENALKTVINDKSYKENIMRLSSLHKDRPIEPLDLAVFWVEFVMRHKGAPHLRPAAHLLTWYQYHSLDVIGFLLAIVLGVAFVVYKCCAFGYGKCFGKKRRVKKSNKSKAH

SEQ ID NO: 7439 - protein, 529 aa, Caenorhabditis remanei
MNFLLLLTLFPVISGYNYLIISPVFGYSHMKFMGKVADILADAGHNVTFLQPILYDYYAHKKVVKNSKVEVVNFEMDEEGKAAASGPSVFKFLWDAKMPSNPISGAKVNSGKLYKEFEHICRRMLTDKHLHEWILSKKFDSHISEAFDFCGLYLGDYLNLKSPIPLYTGVRCGAASYAVGEPIPLNYLPTEGSKYGDESTALDRLNDILGLTAYHYQFALLFDKQYDQVFKLTGGKVRTWQEILQRSTFFLTNSNSYLSFSTPTISKVIQVGGCTIEPPKSTKLDDHFDKILSLRKNTILVSFGTVIQSSDMPTHFKNGLVETFRKMPETTFIWKYEEEDEKLRKELPENVVLSKWVPQPALLADSRLGVFVTHGGLGSTMEVGYAGVPSVMIPIFSDQGANGEMLSRHGGAVVYSKFDLPNSDKLVNTFRKILNNTDYKKNAQRLSDILHNQPMDPKQVLLNHCEFVARFGKVDSLEPHANKYNFIKYYCLDSLALVVCVLLTVLYVIFKLLFFVYNCSISYLKLKQE

SEQ ID NO: 7440 - protein, 523 aa, Drosophila yakuba
MCLGYCWLTVCLCLLLQQDLHQELAQAANILGIFPYRHISPFFVMQPLARTLAKRGHNVTLITPYGMPNDIDGVRHIRVAQLNERIKEMLESDQVLDFMINKWTESTLTAKALFNASYDILSDPGVQRMLHDRNESFDLIIMEPANLDALYGLVEYYNATLIGLSSIRINWHTDELAGNPAPSIYEPISPVGYSLETSLLSRIYNWIHIMEEKLVDYLILRPAQLHLFQKFFGYSSQKMNELRSRFSLMLINSHYSMGKVRANVPNIIEVGGIHLSEPTEPCDEELQKFLDEAEHGVIYFSLGNDILIKFLPVNIQEFLLQTFAKLKQSVIWKSELLYMPNKSDNVYVIEQAPQRQILYHPNVRLFITNGGLLSVMEAVDSGVPMLGLPMFFDQFGNMRWAQLSGMAEVIDINTLNEDILTDTIKHMLGNPSYSVKAKEMSQFFKDRPMSPLDTAVWWTEYALRNRNITRMRLNLEEIPLFEYYKIESLLAFSVRFGLVAVSLIFLVYTLLLKTRVRPRRLHP

SEQ ID NO: 7441 - protein, 522 aa, Diachasma alloeum
MSLIKLLFLFTLILLIHNENTSALKILAIFPFAGKSHFIGGEHLLKKLTRRGHSVDVVSHFPQKDAIPNYRDISIRGSSPIIANNVTFDNFSKFNSVQHKNFVEAAGTDVCDLLGFHVLQELMETPKGTYDVIIVEFFAAHCYIAFGQKLNAPVVGFGTSKLQDWLFGHFGNPLNPSYMPSYFSTFAQRMTFWERLQNTLLISSVCIQFDHYLKTQISQVEKHFGRRISSIDELFNDVSLVLVNEHFSTNDIKPATPDIIDVGGLHIYDNTQRLAPEVQNWLDESIEGCVYFTFGSTVNIESFPKDLLKAFYQSFEKIAPVRVLMRGDPKAHLKDLPENVMILPWISQIAVLKHKNVKAFITHGGLLGTQEAIAHKVPMIGIPFFGDQHTNMRNYENRGIAVILDVKTLNENSLTNAINTVLKDPTYRKNIAKMSALFWDRPMSPVDTAIYWIEYAARHGPVLKSPATELSWWKLYLLDVYGFMLMCILAIIFTIIKLITLLCRCASGTRPKNKVSRANKNK

SEQ ID NO: 7442 - protein, 523 aa, Mus musculus
MAAHRRWLLMSFLFLEVILLEAAKILTISTLSASHYIVISRVSQVLHEGGHNVTKLLYESANIPDFRKEKPSYQVINWRPPEDQEKKFADLRHRLTEEITYGRSKHHTLLKIHQYFGDLCSQLLSRKDIMDFLKNENFDLVLLDSMDLCSLLIVEKLGKRFVSFLPFQFSYMDFGLPSAPLSYAPVYGSGLTDQMDFWGRVKNFLMFLDFSMKQREILSQYDSTIQEHFVEGSQPVLSDLLLKAELWFVNSDFALDFARPLFPNTVYVGGLLDKPVQPIPQDLENFISQFGDSGFVLVALGSIVSMIQSKEIIKEMNSAFAHLPQGVLWTCKTSHWPKDVSLAPNVKIMDWLPQTDLLAHPSIRLFVTHGGMNSVMEAVHHGVPMVGIPFFFDQPENMVRVEAKNLGVSIQLQTLKAESFALTMKKIIEDKRYKSAAMASKIIRHSHPLTPAQRLLGWIDHILQTGGAAHLKPYAFQQPWHEQYMLDVFLFLLGLMLGTLWLSVKVLVAVTRYLSIATKVKEA

SEQ ID NO: 7443 - protein, 533 aa, Pelodiscus sinensis
MAPSSQSEHPIVSRLLLFLVVCSLAEGGKLLVIPVDGSHWLSMCQVLEKLSLKGHEIVVVMPEVSLLIRPSLYYSVKTYPVPHTKEKLDVFFQSLIYLIFDDGPILKKVFIAYESFTSVNTMMLTTCKHFLLNKELIRYLEDSKFDAVLMDPVLPCGPILAEYLSIPSIYFMRGLPCGLDFKATQCPSPLSYVPRLFTSNSDHMPFTQRMKNLLVTATENFLCYLFYSEYERLASEFLQRQVTVLELFSKASIWLLRYDFVFEYPRPVMPNMVFIGGTNCKQKKSLTKEFESIVNASGEHGFVVFSLGSMVSEIPMKKAQQFAEAFGTIPQTILWRYTGQPPPNLANNTKLIKWLPQNDLLAHPKARAFITHGGSHGIYEGICNGVPMVLMPLFGDQMDNAKRIESRGAGVTLNVLDMTSKDLSAALNTVIYDKSYKENIMRLSALHLDRPIHPLDLAVHWIEFVMRHKGAPHLRPAAHDLNWIQYHSLDVIAFLLAVVLVAMFISWKCCLFCCRKCFCKKGRVSKSSKTKAQ

SEQ ID NO: 7444 - protein, 525 aa, Megachile rotundata
MRLLLTVLAAVLTFGQSTEGLRILGLFPLNGRSHWIMGERLLTSLAERGHTVDVVTHFTVKEPPANYTEISLEGTLESAVNKLELSHVVQFNNQNFELLTRMVGDQICKLMDYPKLKQLIDNPPKDPPYDLVIVEMFLASCYLAFGRHLNVPMVGVVTAGSDEWFTEKLGNPFNPSFVPSLFTSYDQKMNFWQRLMNTFLTNMVAFQLDRYVNPQQQYVQKYFGINATITDLYHDLDLLLVNSHHSLLGIRPLTMGIVEVGGLHVKDDGKPLPADLQKWLDESKHGCILFTFGSMVRIETFPESLLRSVYKVFEKIAPVRVLMKVGKKEELLPGLPKNVMTKPWFPQVAVLKHKNTKAFITHGGLMGLQESVHFGVPLVGIPLYGDQHGNLDSASKKLFAVNLRSFKEVNEKTLGDAINTVLYNETYRANIKKVSELFKDRPMSAVDTAIYWIEYVARHGKILQSPAIHLSWWQVHLFDVYGFMLACIVLILYVFVLLVRKLKRKLLDSSCDHKSKKSSNSKKNK

SEQ ID NO: 7445 - protein, 521 aa, Bicyclus anynana
MSLCVHISLTLFLASLNFYVVSSAKILAVYPTPSISHQIVFRILTLELVKKGHEVTVITPDPVYPKGHGPPNLIEIDVRELSYKIWTDVWMSDKSISEADYYSQIYFILRSMSKITVTQIVSSKEIQALIKNNKTDYDLLLIEAFVRPVLIYSHIFKVPVIQISSFGGLSYNFKAFGVPTHPFLYPAIPTQRLYNLSNYEKLQELYYQWQMENTFNEIEEEDNRSLQQVFGTDIPSIRELYNNVDLLFLNIHRIWMDNQPFPPNVIHIGGIHTNPKTKGLPKDLDLLMNNAKNGVIYFSLGTNVNTTNLPFDKIQVITKVFSQLPYDIIWKCNQDSIPGKTENVKLYKWVPQADLLKHPKIKLFITQAGLQSTDEAIEAGVPVIGIPIFGDQWYNAEKYQQLKIGIKLDLKDLTEEMFKGAIETVISDDSYRSNMKRMRKIIKDEPQTPLERAVWWVEYVLRHKGAKHLRAAGANISWTQYLELELVAIVVLFLLSILLIFFVTIYYVMKSLRAYSKVKTS

SEQ ID NO: 7446 - protein, 518 aa, Papilio polytes
MILRISVLYLLCVTLSFIESARILGVFPTPSISHQVVFRTLTHELARRGHEVVVITTDPVHPKEKVPENLTEIDVHDLSYSKWNKVVSEMEDGSRDVTSQVKAIILVGMEIFEDQMKTESVQKLLSYKDDHFDLILVEALVSYTLGFSHVFKAPVILVSSFAGVWENYEVIGAPTHPILYPSSVRDRVNNITMWEKIVQLKKDYKMMAMKKNYDMMNNLIKKVFDADTPPIQKLFDNVAMLFLNVHPIWDNNRPVPPGVIYMGGLHQNPIRELPKDIKEYLDSSKNGVIYFSLGTNVKPSYVPPEKLQAIVNVFSRLPYDVLWKWDNDELPGRSNNIKLAKWLPQSDLLRHPKVKLFITQGGLQSTDEAISAGVPLIGIPLLADQWYNVEKYVEHKIGVRIDIDTVTEEIFETAIQTVIKDKSYRENIVRLRSIMNDQPQSPLERAVWWTEHVLRHGGARHLRSPAANISLTQYLELELVFTLATILILSLYILFIVIKALWHFVHTSLSLKVKIKKP

SEQ ID NO: 7447 - protein, 532 aa, Equus caballus
MACLLRAFWRVSAVVFFLALWGMSVGDKLLVVPQDGSHWLSMKDIIEPLSEKGHDIVVLVPEVNLLLKESKYYTRRIYPVPYDEEEMVSRYRSFGKNHFAERWLLNAAQTEYRNNMIVINMYFTNCQSLLNHSETLSFLRESKFDALFTDPALPCGVILADYLGLPSVYLFRGFPCSLEFAFTRSPNPVSYVPTCYTQFSDQMTFPQRVANFLANYLKDYLFYCLYSKYEDLTWNVLKRDVHLPSLYRKVSIWLLRYDFVFEYPRPVMPNMVFIGGVNCKKEGTLPQEFEAYVNASGEHGIVVFSLGSMVSEIPEKKAMEIADALGKIPQTVLWRYTGTPPPNLSKNTILVKWLPQNDLLGHPKTRAFITHSGSHGVYEGICNGVPMVMMPLFGDQMDNAKRMETRGAGVSLNVLEMTSDDLANALKTVINDKSYKENIMRLSSLHKDRPVEPLDLAVFWVEFVMRHKGAPHLRPAAHDLTWYQYHSLDVIGFLLAVVLGVAFIVYKSCAFGFRKFFGKKGRVKKSHKSKTQ

SEQ ID NO: 7448 - protein, 518 aa, Bombyx mandarina
MNFQTIHLLVLSALACDAYKILLVFPYVSKSHAILGEGYVRNLLKAGHELTYITPYPKDPAPNLRVIQIAQHALEEKMNSTFTIEKLMHKTHAGMEMFKLVKSFINTANDTVSNTEVQQLMLDPQTHFDVVIAEWMVTEIFSGFGKIFNCPFIWSSSMEAHSLILRLIDEIPHPAYSSNTLGLFEPPYNFFQRAINTLMEIGLKVAKWFSISIEEHIYKEGFAAAFKARGLVQPSLEELRYSAALVLGNSHVSSGAPLTLPQNYKAIGGYHIDEQSKPLPKEFKNILDNSKHGVIYFSLGSVVSSKSMPAAIKTGLFEMFRSLKYTVIWKFEDDFQNIPDNVHVVKWAPQQSILAHPNCILFITHGGLLSTTETLHYGVPIIGIPIFGDQAMNVKKAVHKGIGLEVKFGSDTPKNLKAAINEVLSNQKYRDRVKELSLVYHDRPVTPAAELVHWVEHVVKTKGALHLRSQGLHVPLYQKLLLDIIFVSLLLFLGFVFFVKFMVTRYLKKKIDIRKKTL

SEQ ID NO: 7449 - protein, 516 aa, Anoplophora glabripennis
MDKYLLLLLVLSLASSLQCARILGVFQMPTVSHQSVFQSLWKELSLRGHDVTVVTPYPLKDPRLVNLTEIDMSYASDSMKRHGFQFFMRKEFAVHTKIPKIFAINYDAADAIFSNTEFIKIYNNSNEKFDVILVQTYISPIMYSLGYKLGAPVIGVASMGGYVGSHYAMGNPNPPSLYSEMFLPYNGKLTFYERLCSTLYYIWLRFYLTFVAIPRCDEIARKYLGNDMPYMGEIEKNLSLLFLTTNPIFYPPRPTVPTIIPLQRLHMKPPKPLPKDLQTILDNAKNGVIFFSLGSNVQSVNMPDRLRIVLNEAFSELPYTILWKYESVDLPGKPSNVIIKKWLPQQDVLAHPNIRAFISQTGLQSTEEAIDRGVPIIGMPFIADQSMNTRVVAEIGIGVGVDYETVTKEELKNAIIEVAENEKYKRNIEKLRDLMLDEQVPPMEKAIWWIEYVIRHKGTKHLRSPTVDISWIEYFLIDIAFVVLLISTIIIYSIYKIVKVLRNCNKATVKKNGKND

SEQ ID NO: 7450 - protein, 513 aa, Helicoverpa armigera
MMYAQSFLIFTLLITFNDAAKILAMFPVPSISHQVAFRPLTQELARRGHEVTVITPNPTFPKGGAPANLTEIDVHDISYGIWRKLYEYTSGTTSPTTQTRIAFQMMVQLVEKQLQVDEVQRLIKEEKFDLLFLEAVAPALIVSHIFKAPVIQISSFGPMNFNVETIGAAWHPLLYPNSFSQKLYNMTKWNKLEELWNFYSLEDVVRESDVLEYEMAKRLFGENAPTVKELRDNVDMLFLNTHRMWEGNRPAPPSVVYMGGLHQMPPKELPKDLKTYLDSSKNGVIYVSFGTNIQPSLFPPERVQMFIKVFSELPYDFLWKYDKDELPGRTSNIRISKWLPQPDLLRHPNVKAFITQGGLQSTDEAISAGVPMVGLPIVADQWYNTEKYVHHKIGVKLDLDELSEQQLKNAIKTVVGNKSYRENIVKLGQLMYDQPMTPLERAVWWTEHLLRHGGARHLRSPAANISWTQYLELELVLTVLSVILGLVSVLLGIVYYLWKSFTSKSVSKKVKKN

SEQ ID NO: 7451 - protein, 515 aa, Diuraphis noxia
MNILLLTSLLAVQSCPRIIFGARILAIEPCGSKSHWQYMKSILDLLAVRHHVTVITPLLTNNRENYTEIDASQVLPIYPLMGAMEMIEQYGSVMNILPPWPKRSHERDICDAFYEFEPIRDLLNRGADGRYDVIMLEPFYSPCLSYLAHKMRVPEIYVIPSSMITMESMLFGTEPNPSYVPHLLYNGAVMDGFMQRLTNVALFAYVKIVVWLTNVRMMYREPRPYDIAGIRHNPSLVFINTHFITESPRPFPVKMIQIGGIHLQPPKVLPEDILEFIENSPHGVIYFTFGSVSSMATLPKHILQTFIEVFAQVPQRVLWKYDGEISDLPKNIMTRKWFPQRDILLHPKVKLFISHGGISGVYEAVDAGVPVLGFPLFYDQPRNVINLVDAGMALSMDLLTVNKIEFLKNINKLLNDKKFSIRAKIVSKHFKDRPLPPSEMVNYWFEYVLRHNGASHLNSKAFNLTWYQYFLLDIITVVVILLVIFAYLTFILFRWFQYYTLKLYKLNQSHITVKK

SEQ ID NO: 7452 - protein, 521 aa, Gekko japonicus
MPTWLLLTSLFWSLSDGGKVLVIPLDNSHWLSMRLVVERLHQKGHEIVVVAPDVNMRIEPSLHYTLKTFAVSYTEEYMKEQLQNIGQNIFSQQPFLARMTETIARTRIISTLFLNTCKELLYNKEMIAYLEENQFDVVFMVPVSPCGQIVAERLSLPSVYYSRGFPCGLEATQCPNPPSYVPRFFTGNTDHMDFSQRVKNFLAASLEFLFCYLLYSPFHVLSTEFLQREVTVSELYSQASVWLLRYDFAFEHPRPLMPNMVLIGGINCEKKSPLIEEFEAIVNASGEHGIVVFSLGSMVSEIPMKKAMEIAEALGTIPQTVLWRYTGEVPPNLAKNTKLVKWLPQNDLLAHPKARAFITHGGSHGIYEGICNGVPMVVMPLFGDQMDNAKRVESRGAGVTLNVLEMTSKDLSDALKAVINDKTYKENIMRLSALHLDRPIHPLDLAVHWVEFVMKHKGAPHLRPAAHDLNWIQYHSIDVFAFLLAVLLLVLFISLKCSLFCFRKCFGRKGRLSKKSKSKSQ

SEQ ID NO: 7453 - protein, 458 aa, Papilio machaon
MVSNSVIYLLCFTISCIESARILAMFPTPSISHQVVFRPLTQELAKRGHEVIVITPDPAYPKGQAPKNLTEIDVHDISYSKFKILMERIKDVARDVIKQVEVIIDSNNAVFEEQMKTESVQEILKYKDDYFDLILVEACMRPAIGLSYVFKAPIIQVSSFGAIMDNHYIMGTPTHPLLYPSMSRDRLYNLTMWEKFTQLRKEFIAGMDSEILHTYDLKSYLDSSKNGVIYFSLGTNVKPSNLPSDKLQVIINVFSRLPYDVLWKWDDEELPGRTKNIKISKWLPQSDLLRHPSIKLFVTQGGLQSTDEAITAGVPVIGIPMLGDQWFNAEKYVHFNIGHKLDIDTLTEEQFDNAIKSILNNNSYRENIVRLRSIMQDQPQSPLDRAVWWTEHVLRHGGARHLRGPAANISWAQYLELELVLTLAAILISSLIILFIVAKLIWNVLKVQLSAVIKVKKS

SEQ ID NO: 7454 - protein, 356 aa, Aethina tumida
MILKFSDSARILGIFQMPSFSHQCVFQPIWKELALRGHEVTVVTSHPLGKLMYINPIFVSLGSRFNAPVIAISSMGAYIGTHFAMGNPHHPAMYSEMFLPYHGKLTFTERWYSTFYYLWDLKNELDRAKNGVIYFSLGSNVQSVNMPERFRNVLIETFAELPYTVLWKWESDHLPNQPKNVITRKWLSQQDVLAHPNIKAFITQCGLQSLEESFHAGVPIIGVPFIADQEMNIRRLNEYGIGIGVDYLTVTKEELKAAIVEVAGNDKYRKKTREFNKLLNDHPQTSLERVVWWTEYVIRHNGTTHLRSPSVDINWCHFLLLDVIGVTLAIVIAAVYLILKILCLLCRSKTPKLKTN

SEQ ID NO: 7455 - protein, 517 aa, Bombus impatiens
MNFQFLLSVISCVIFSVNGARILVLFPHQAKSHYIVFEPLLKKLAENGHQVVSVNFFPQKTPLPNFTDIDISSSLPSLVGTKTVSNSFKTFKWEVLRGVLSHGAPSCDPVLNHPALKKLLRSKEKFDVCIIELFATDCFLGIVHTLNIPLAVGATSSAILPWTNEIMRNPEIPSYIPNWMNGLTDQMNFFERSINFVDFLVTKSAYRYLSDKPGHEIAKRHFGDDLPDFDTLRSRISLVLTNGHAAVSTPRALAPGFKELGGIHILSSNPPSLPADLQNFLDSHSKNGVIYFSLGSQIDSSTMSEQALAAFYRAFEQVPQQILWKCTGGKMPTLPKNVKCIEWAPQLSILCHPNVRLFITHGGLLGAQEAVYCGVPILGIPLFGDQHLNMAYFVKKGLALKLDYRQLSYAPVSNALNELLVNKSYTDMARKASSQFKDRPIPPLDEGVYWIEYLLRHGPNSLKTAAVELTWYQYLLLDVISTMVISIIFTIWIVYKLFKLLFCRRKMVSVDINKKQS

SEQ ID NO: 7456 - protein, 518 aa, Habropoda laboriosa
MNFLFALTLIACVIFGVDGARILVVFPHQARSHYNVYEPLLKRLAEKGHQVVSVSHFPQKTPLANLTDVDVSSSLPSLIGTMTMSQSDKVYKWLKLKSVLENRGSVICDPVLSHPGLRKIVQSREKFDVYIVEIFVSDCFLSIAHVLEIPIVIGTITSVTVPWANDVLRNPEIPSYIPNWFSSYTDRMNFFERFGNSVDFFVTKLAYRYLSDNPSYEIAKKHFGNDLPDFDTLRSKISLILTNGHPVISTPRAVAPGFKELGGIHIPPSGPQPLPKHLQDFLDAQGNDGVIYFSLGSQINSSTMSNQVFAAFYKAFEQVPQQILWKCSEEKMPRLAKNVKCIEWAPQLSILCHPNVRLFITHGGLLGTQEAVYCGVPILGIPLFGDQHLNMAYFVKKGLARQLNYQQLSYEPLSNALNELLTNKSYTDTARKASLQFRDRPIPPLDEGVYWVEYLIRHGPGSLKIAAADLTWYQYLLLDVILVTIVSILLATWSVYKLCKLVFRRKNVASVSSNKKRM

SEQ ID NO: 7457 - protein, 527 aa, Papilio machaon
MRGLIFLSVLSLVVFSHVNCARILGLFPHPGKSHQMVFEPLLKTLAERGHHVTTVSFFPLKNPPENYTDISLENISEVLLESLDLSLFESNGVISKIPVLRRVLGLMFEFQPLAHFALHVCENMIQWEPLANVLKKEYDVILLENFNSDCMLGLLHIYGNTAPKIALSSSNLMPWSAERIGLIDNPSYVPMVSTGFTSRMTYTERLENSFLSVFYKLWFYKSVQVKEQSLIEKRFSKAVPDLRDLSRNYTLTLVNTFHALNGVRPLLPALVEVGGMHLDHTLKPLTPYIEKFLNESEHGVILLSFGSLIKTSTIPKYKEDMIVNALAKLKQRVIWKFEGSGEEGTLTGNILRVKWLPQYELLQNKKVVAFIAHGGLLGMTEAISAGKPMVVVPFFGDQPANAAAAAAAGFATVVPYIELTEEKLTKALEFVLSAETRLNARRVSSIWRDRQADPLETAVYWTERVIRWGHHAQLHSPARDMPLYQIALLDVIATLVIAILIILAISWYILSKVFRLLFGRESKLKMH

SEQ ID NO: 7458 - protein, 512 aa, Helicoverpa armigera
MSISLVLFLLSFSYNDAARILAVFPVASISHQVVFRPLTQELARRGHEVTVITTDPAFPKGGAPANLTEIDVHFTYEYMRKFYKLSSSAEGDVVSQMKFAFEMMIEAFEVQMKSEGVQKILKEGKFDLLLVEACVRQALVLSHVFQVPVIQVASAGPTNFNLDSFGTAWHPLLYPLPFSQRVYNLTNWEKLTEIWKFYQLEDIFNKCGEKEDEANRRVFGPNVPSVAELGNNVEMLFLNVHPFWEDNRPVPPSVIYTGGLHQKPAQELPKDLKSYLDSSKNGVIYISFGTNVQPSLLPPEKVQILVKVFSELPYDVLWKWDKDELPGRTSNIKISKWLPQADLLRHPKIKFFITQGGLQSTDEAITAGVPLIGFPMLGDQWYNAEKYVHHKIGKQLDLATVTEEQFKNAINTVIEDKSYRQNMKNLRDLMHDQPMTPLERGVWWTEHVLRHGGARHLRSPAANMSWTQFLELELILTVLATALSCLLLLLVLINCSWKHFTSTPKPKKKKKQ

SEQ ID NO: 7459 - protein, 513 aa, Leptinotarsa decemlineata
MWLLKLINLALLCFGLILESDSAKILGIFFVPSISHQIAYRPIWRELSIRGHNVTVISPNILNDSSLTNLTEIDVSFAYDILGKFDLQKNAAKENFLVKNFITIHNMMFSVMHAILEYGAVQDLIHSDEEFDLILVESLHPLVFSFGARFKAPIIAVSSIEVFVYIYDIFANPTHPISNPDMMMYFEREPSFIERIRSLTHNVVSRLCYYWWILPQSDVLARMYFGEDMPDLEKIISNTSLLLINRNPIMHSPRPNVPTIIEIGQMHIREKKNLPEDLQTYLDSSEKGVVYFSLGSNIKSANLSGGLQEIIKQALSELPFDIIWKWETEQLPGKPDNVLIREWLPQQDILGHPNVKVFVTQGGLQSLEEAVVNGVPMVGIPFWMDQFNNVKILADKEMGIGLNYNTMTKDELRKAIFEVATNSKFKKQLEKAKNILLDQPVTGLNKAIWWIEYVLRHKETTHLRTPSADMSFFQYFMVDVFAFLLLSICIFVYLLKMAFRMIVGSKNNKIKTN

SEQ ID NO: 7460 - protein, 518 aa, Trichoplusia ni
MRIYLYLLTCYVLFVNSNEAAKILGVFPTPSISHQVVFRPLMLELAKRGHDVTVITTDPIFPKGGTPSNFTEIDLHEKSYRIWRETFLKLSSGSKDDLVAQTESLKMIQEIFEVQINDEQVQRLLRENKHFDLLILEACSRPALIYSHIYKAPVILMSSFGAIFDNFAVIGAPSHPLLYPDVLRQKLYNLTMWEKITELRTNYKISSIYAQNVVQEDKLLRSLFGPDTPSLTDLANNVDMLFLNVYPVFDGIRPVPPTVVYTGGLHQKPEKELPDDLKTYLDSSKNGVIYISFGTNVDPTLLPPARVQVLVKAFSQLPYDVLWKWNGDELPGRTANIRISKWLPQSDLLKHPKIKVFVTQGGLQSTDEAITAGVPLIGVPMLGDQWYNVEKYVYHKIGVGLDLEHLTVEKFKNTIIEVISNDSYRRNIIKLRGLMRDEVQTPLERAVWWTEYVLRHGGAKHLRSPAAIISWAEYLELELVLTIMAGLLLSLVIFIAIVISLYKYVLRHYVAAVKIKST

SEQ ID NO: 7461 - protein, 530 aa, Cavia porcellus
MAPARLPAPLSLCLCLLLASGFAQAGRLLVVPADGSHWFTMRSVVEKLVQRGHEVVVVMSDVSWQLGQSLNFTVKNYVPSFTLEDLNREFKVFVDNAWKFGSQSVFSAVIHPSSRSFDLLFSQCRSLFNNKELVAYLKEASFDAVFLDPFDPCGLIVAKYFLLPSVIFGRGALCSHIEKGAQCPSPPSYVPRIFLRFSSTMTFKQRIQNYISYLEEMVFCPYFLKKTLEIASEILQTPVTTYDLISHTSIWLLRTDFVFDFPRPVMPNMVFVGGINCHEGKPLSEEFEAYVNASGEHGVVVFSLGSMVSEIPEKKAMAIAEGLGKIPQTVLWRYTGTPPSNLAKNTILVKWLPQNDLLGHPKTRAFITHAGSHGVYEGICNGVPMVMMPLFGDQMDNAKRMETRGAGVTLNVLEMTSDDIADALKKVIYDKSYKDNIMRLSSLHKDRPIEPLDLAVFWVEFVMRHKGAPHLRPAAHDLTWYQYHSLDVIGFLLGIVLLVAFISFKCCAYGFRKCFGKKEQRKKTQKSKTH

SEQ ID NO: 7462 - protein, 528 aa, Papilio xuthus
MRIYIFLLILAAIASHDAGDCARILGLFPHIGKSHFMVFEPLLRALAERGHHVTTVSFFPLKNPPANYTDVVLEGAVQDGLSSMDLSMFEVSNPLMKVPLLNTILKNIFEMGMTAPLAVSTCESIIRQSSVIEALKQKYDVLIVEQFNSDCMLGLTHVFGIEAPIVGISSCGIMPWTYARIGLHDNPSYIPLLTTPYTSKMTFIQRLDSFISKLYVNDLYHIIQRKERAIIEKHFRVEIPDLDEIGKNKMSVFLVNTFHTLNGVRPTLPAVIEVGGMHLDHSRKILPSYIEKFLNESEHGVILLSFGSLIKTSTIPKYKEDMIVNALGKLKQRVIWKFEGSGEEGTLTGNILRVKWLPQYELLKHKKIVAFITHSGLLGMTEAVSAGKPMVAVPFFGDQPANAAAAAEAGFATIVPYVDITEERLTKALQFVLSPETQLNARRVSSIWRDRQADPLETAVYWTERVIRWGHHAQLHSPARDMPLYQIALLDVIATLAVAIFIFLAILWYMLSKVFRLLFGRESKLKMQ

SEQ ID NO: 7463 - protein, 403 aa, Papilio machaon
MMDDEEVQDLWKTKMKFDVAVVEQFNGDCALGLAYILNTPVIALTSHLLMPYHYDRYGISYNPSYIPFLLLEGSTESTLMQRLAHTISHIYMKFIYQYLTQRYEYKIISKYVNNMPPLEELGRNIKFLLLYNNMMLTGSNILPANVIEVGGYHVAKPQPLRDDLLKFIEESEHGVIYISFGSMLRTASIPKDKMQAILTALAELPQRVVWKWEAKSLPGKPKNIFVSKWLPQNDLLAHPNVTAFYSHCGMLGTTEALYHGVPLVGMPMFADQFRNAAAVEESGFGVTIKLENLTKDNLLKKFKTVLDPMFQANVKLLSKAWHDRPKSAMDTAIHWTEFAAKYPTLTFRSPAADVPLYQYLCLDIIFILSIIPITVICVVAIIYKTYFKSKSKQKSIKKKDKNM

SEQ ID NO: 7464 - protein, 525 aa, Polistes dominula
MNVLTYIIVCLTMCLTLCQSYRILGIFTFHGKSHFIMFEALMKGLAKKGHQVDVISTFPLKKPVENYTDLVSIPVKLKLVNNVSYEFMKMALSGAMAVNAVASIGGNDLCEYLELPEIQKIIKNPPQNPPYDAVLIEIFGASCFGIFGNILNVPVIGVSSSALYPWANPYIANPENLAFVRNNLLSYVKEMNFGQRVYNTLHTLFNKMYFNYKTTKYQDELIKKHVGPNMPSVREVETNISLILVNTYFSLNGIKPKTPALIEVGGLHVQDDDDTELSPELKKWADECDKDGFIYFSFGSMVNIETFPKHILDIFYKSFEYISPVKILMKIPNPKNLPPGLPNNVRIAPWLPQLKILKHPNIRAFITHGGLMGTQEAIACGVPMIGIPLFADQFTNIESYVEKNIAIKLDYETMTQNDMNDALHKIVYNSTYRKTARIIADKFIDRPLKPIDTANYWIEYVIKHGYNSLHSPALNLYWWQVALLDVYVFIFVVTLVIIYLIVHLTLLLLNVFSSNSKVTHKKKVT

SEQ ID NO: 7465 - protein, 201 aa, Stomoxys calcitrans
KFENDELPNKPENVILRKWFPQPSVLAHPNVKLFISHGGFLSTTETIYHGKPILGIPFFGDQFMNVKNAVKAGYALSFKVADITKDSLKSAIMELWTNPRYAQAVQQKSKYFRDTPLTPLETATYWMEYVIRHKGCAHMRNAGLDLNFIQYHNIDVFVILAAAVVLLVTLLVAILRKLKHLLFGNSKRKGNSKHSKKSKLN

SEQ ID NO: 7466 - protein, 290 aa, Danio rerio
MCETMGKVDICLIRTYWDFEYPRPFPPNFKFVGGLHCKPAKPLSKELEEFVQSSGDHGVVVFSLGSMIKNLTSERANTIAAALGQIPQKVVWRYSGKTPETLAPNTKIYDWIPQNDLLGHPKTKAFITHGGTNGLYEAIYHGVPMVGLPLFGDQPDNLLHIKTKGAAVVLDIHTMGSKDLVDALKAVVNNPSYKESIMRLSRIHHDQPMKPLDQAVYWIEFVMRNKGAKHLRVQAHELSWYQYHCLDVAAFLLSITALITFLWVKACCFLFRRCVRKTRPERKRQKNKKE

SEQ ID NO: 7467 - protein, 528 aa, Amyelois transitella
MRAVLLAALLAAAGPARAARVLGLFPHTGKSHQMVFEPLLRRLAERGHHVTVASFFPLADPPENYTDVSLQGIAPLGLETIDLALFENQNWLLTTLGVQKIVNQINEFQPLAGMALDVCSKLVSWSPLEEALRKEYDVVLVENFNSDCMLGLMHIYGLQAPTVALLSSGLMQWSAQRVGVNDNPAYVPIVSSSFTSRMTFLERLENTVLNVYYKLWYRHFIQVKEQELIEKHFGRKIPDLESLSKNISLMLVNVFHSLNGVKPLLPGVVEVGGMHLDHSEKPIPEYMERFLNESEHGVVLFSFGSLIKTATLPPHKERLIVRALARLRQRVIWKYEDSGELGTRQGNILKVRWIPQYQLLRHKKVVAFVGHGGLLGMTEAVAAGKPMVVVPFFGDQPQNAAAAAAAGMATTVSYADLTEESFTEALHTVLSAEVRLNARRLSSMWHDRAAPPLDTAVFRTEHAARWGPRDPLHAAARDLGYIQIALLDVAAAVLLAICVLVLLVILIVSIILRILKRLFSSKRKEKLH

SEQ ID NO: 7468 - protein, 524 aa, Habropoda laboriosa
MKLLSIVLLCTILSVCHGYRILGVFPFNGKSHFMMFEQLMKALAKRGHQVDVISSFPLKKPYPNYNDTIVLKAPREFMNNMTYEDVTIVFKDSPAFVVATLAGNAVCEHLNDPGIQDLIHNPPKNPPYDVIVMEIFGAHCFAILGEVLKVPVIGASSSALYPWTYDFIGNPGNYAFAPSILLSYPQNMNFWQRTYNFVYTLYNKWEFMSASSEQTELLRKYVSPDAPSVRELERKIAMILVNSHMSMNGIKESTPAFVEVGGLHVQEEGVEISPVTIILLEKWMNESTNGFIYFSFGSMVKIESFPSRHLEIFYNSLEKIAPVRVLMKIANPQELPRDLPKNVLALPWIPQVKVLKHPNVKAFITHGGLMGTQEAIHYGVPLIGIPLFADQFINIDTYVRNNIAVGLDLKTLTQEKMDEALNAVLNDPKYRDTMRKISKRFLDRPLSPADTAVYWVEYIIRHGANALRSPAMDLTWWQVELLDVCAFLLIVVLGVLYLLATVVQFMFYLTNSSQHSVPRKKKAA

SEQ ID NO: 7469 - protein, 524 aa, Chilo suppressalis
MSNIPQTSVLLLLLLSVCGNDAARILAVYPTPSISHQVVFRPLTLELLKRGHELVVITTDPIFPNGKAPANLTEIDFHDKSYTLWREHFLKSIVNQGTKEDSMEKGLLMYYTMLEIFKEQITSKEVQTILKDKSNKFDLLLLEAYFIPALALTHFIKAPVIQISSLGSTVENLAIVGASTHPLLFPTMVHQKIYNQTMWDKLRELIVYCYYTFFVGEVSTKTERFLKETFGPDLPDTSQLRNNVDLVFLNVHPIWEMNRPMPPNVIYTGGLHQNPQKELPQDLKEYLDLSENGVIYISFGTNVNTSLLIPEKVQIMIDVLSTLSYDVLWKWNTDELPGRSKNIKISKWLPQSDLLRHPKIKLFITQGGLQSTDETITAGVPIIGMPILGDQWYNVEQCVHHKVGVYVDMGTMTEEIFKQALDEVLNNDSYRRNMQRLRALMRDQPQTPLERAVWWTEYVLRNGGARHLRSPSANITWSQYFELELVFYISIVIITLLVLLGYISLKVLKLIKNSLFAKAKVKFS

SEQ ID NO: 7470 - protein, 398 aa, Apis cerana
MFEALCKGLANKGHQIDMISHFPLKKSIPNYTDIIDLSGTRKPIVSSFTIDFAKILDRSLVYYMATDFGTSLCYLMGNEKMQKFIKNPPNDPPYDLIITEYFASPCYLGFGHLLNAPVAIATSFLEMPYIDNFMGNPLNYGFFSGHYNDYPVVDTFLDRLWNFIVNYKEEQKFYYYTSDQTDIMRKYLGLPNLPDIRELERNVSLAIVNSHHSYHGIRAVTPAIVEVGGIHIVESDQKVNPELKKWLDSANHGLVYFSMGSILAIEEMSKEIILTFYQSFAKISPIKVLIRCANSTKLPPGLPSNAMTFPWIPQIAVLRHKNTRVFITHGGFGGTQEAIYYGIPMIGIPVFSDQKKNIYALVQKNMAVAVDIDNINEDVINTALDAVLHDPKYRITTE

SEQ ID NO: 7471 - protein, 520 aa, Ostrinia furnacalis
MDKAQIILCVLGVICCADAYKILVVFPFPIRSLNNLGEGYVRHLLKAGHEVKFITAFPLKNEKNEKLRQIDISSNHQLMVSGDSTFSIKSVMDGQIPMNDVKMMQEFGLYSSIMMFEHENVKKFLEDTSQQFDAVIVDLYETEIYSGLSALYNCPMIWSYSMGAHWLVLRLIDEPTNPAYSADYLSSNVLPFTFKQRLEELWAQILWTWTKWTSTMPKEKEAFTKYFKPLLENRGHTLPDYDQLIYNASLIFGNEHHAFGNIPRTPQNFKFIGGFHIESPAKPLPKDLQTLMDNSKDGVIYFSMGSTWNSKDLPESVVEGLVKMFGELKQTVIWKFEADLPNLPKNLHITKWAPQPSILAHPNCLFFITHGGHLSSTEAIHFGVPIIGVPIFFDQFININKALSKGYALKVHLNYDLPRNLKTAIQTMLSDSNYRKQAKELSSIYHHRPVPPGQEMVHWVTHVIRTGGAPHLRSPALNMAFYQKMYLDFAALVAVIVVAVVLVVKKLCGGRKAVPKEKRN

SEQ ID NO: 7472 - protein, 524 aa, Trichoplusia ni
MIRAKVLIYICLYTAVTYVDSARILGVFSMPSISHQVVFRALTFELAKRGHELVVFTPNPVSPAEGIPNNITEIDTGQSYQILKELMERALNKKVLQRGVIMNLRSMNGEALSRAILKIVSSQFDLPEVRKVIEDKTQKFDLVIVEPILSVPLIVGKIFNAPVILLSSFYGSSDIFEIMGAFSWHPMYYPSFYRTKYKDLTLLEKIGAVYLEWRLIKSTLETDEKQNEFLKTRFGPNAPTVRELRNNVQMLFLNAHPIMGNNRPVPPSVVYLGGLHLKPPKPLPQDLQTYLDASIRGVIYVSFGTNVRPSNMDQDFLDAFLQAFESLPYDVLWKFDGDNLERIPKNLKIQKWFPQRDLLLHHNVKAFVTQGGLQSSDEAIDAGVPLIGIPMLADQWYNVNKYVELGIGVQINALTMTADDLTQAVEKIVSDTSYRQNIRRVRAIINDQPESPLERALWWTEHVLKHGGNHLRAPSANTTWSEHLMLDVVLLVLSIILVTGFLLIYASFKIWNLLKYKLEKVKLH

SEQ ID NO: 7473 - protein, 530 aa, Cryptotermes secundus
MAGKLYILVALVVALLTTSESAHILGVFPIPAKSHNIVFSALTRELARRGHQVTVISPFREKNPIPNLTEIEVKLDLTDDFSGNLFNLRHKGTLELSRSQWKSAPAFCVSIFQHPQVQTFIHSKHHHFDAIIVETFANECVLGFAHKFQALIIQICQFGGTHWMGDWLGNPNPYAYIPDAFLDYSSHMSFGERLVNTLTGVYWRTGQEFYSIPRQEAVMRQYFNDTDDIPPLADIVRNTSLLLLNNHFSLNYPRPLVPNMIEVGGMHVQTAKKLPEDLQIYLDEAPNGVIYFSMGSLLQGSQMPDSVRKAFVEAFSKLEQKVLWKWETDSLPGQPNNVKLGKWLPQADILGEVPVPCAAHPNVRLFITHGGLLSKQEAINRGVPLLGIPVYGDQYLNVRKAESLGYGIRLEFDNITAESVLWAIQTALQPRYRENAQRLSRIYRDQPLTPLEQAAFWTEYVIRHKGAPHMRSAALDLTWYQYFLLDVIAVLALAVGVFLLLALLISRAIFRKLCGATPKDKNARHKKKIN

SEQ ID NO: 7474 - protein, 498 aa, Aethina tumida
MKNIFYISCISLLNIHLVFCSRILFVAPIPSYSHQIFFRKIWLKLAERGHDLTVLSTDYMENAPKNVRQIDWHFTYQLRHNKYNISQVYLDNEDDIAKVISVYITMLNEISDRELSQPDVQQLLKNRDEKFDLLIAEFHHPLVFAFSSYFNCPYIGISSANIDNSFHELLGNPAHPLLYPSIFSPLDGQMTFRTKVDILTFWIKSRFNKYSHGDPYHDELARKHFGSNLPPMLDIIRNVSLVLINTHVVFDDRPLLPGLIRIGGGTHLEPAKALPHNIQEFLDDAPEGAIYFSLGTNVKSTCLKPDTLNAFIEAFRELPFKVLWRFEDDLKNVSTNVKIFKWLPQSDVLRHKNVKAFITQGGLQSIDESIFSYVPMIVIPFVSDQKLNARNIKRKGLGVYLDKSNLDKECLKQAILEVISNQTYKTNVKNIANYIEDQPMSGLDTAIWWIEYVIRHKGTKHLWNFDNILPLYEYLMLDVIFYMIFIKLTPLYLAYILG

SEQ ID NO: 7475 - protein, 454 aa, Rattus norvegicus
MGETFSIEKSHPGNRIMHYRVDLCPQKVKLNKLQFEHHTIVKIHRHFGDLCNHLLSRKDIMEFLKNANFDLVLFESVDYCSSLIVEKLGKQFVLFLAFQLGFMDFELQRVPLSYVPVYGSGLTDQMDFWGRVKNFLMFFDLSRKQREILSQYDSTIQEHFAEGSRPVLSDLLLKAELWFVNCDFAFEFARPLFPNIVYVGGLLDKPVQSIPQDLENFITQFGDSGFVLVALGTVATKFQTKEIIKEMNNAFAHLPQGVIWACKDSHWPKDVTLAPNVKIMDWLPQTDLLAHPSIRLFVTHGGMNSVNEAIQHGVPMVGILFFSDQPENMIRVEAKTIGVSIQIQTLKAETFARTMKEVIEDKRYKSAAMASKIIRHSHPLTPSQRLEGWIDHILQTGGAAHLKPYAFQQPWHEQYLLDVFLFLLGLTLGTVWLCVKVLGAVMRYLSGARKAKQT

SEQ ID NO: 7476 - protein, 518 aa, Bombyx mori
MNFQTIHLLVLSALACDAYKILLVFPFPSKSHAILGEGYVRNLLKAGHEVTYITPYPRDPAPNLRIIQVSQHDFEEKINSTLTIEKLIDYSFTVMEMFNITKSFIYTANDTVANTEVQQLMLDPQTHFDVVVAEWMITEIFSGFSVIFNCPLIWSSSMEPHSWILPLIDEIPHPAYSSNILGLFEPPYNFVQRAINTSLEIALKVIKWLVTLIEEQIYKEGFAAAFKAKGLIQPSLEELRYSAALVLGNSHISSGAPLKLPQNYKAIGGYHIDEQSKPLPKDFKNILDNSKHGVIYFSLGSMAPSKSMPAAIKNGLFEMFRSLKYTVIWKFEDEFQNVPDNVHIVKWAPQQSILAHPNCILFITHGGLLSTTETLHYGVPIIGMPMFGDQVMNIKKAVHKGFGLEVKLNFDTPKNLKAAINEVLSNQKYRDRVKELSLIYHDRPVSPGAELVHWVEHVVKTKGALHLRSQALHVPLYQKLLLDIIFVSLLLFLGFVFFIKYMVTRCLKKKIDIRKKTL

SEQ ID NO: 7477 - protein, 526 aa, Poecilia reticulata
MKLHITFFVLLLLSAANGGKILVWHTDGSHWINMKPVLETLVDRGHQVTVLVPSTSMFMNSSEPSRFRYEPFNVSVSMEFKKKFIEEFLLFSIYEVNHMSYLQIYNKFIGFIRTNMDYFLKFLHRVVKSETIMKKLKKGNYDVLFADPIYPGSDLAADMLGIPLVFSLRFSLAHNWERMCGQLPAPPSFVPGIMSKLTDKMDFSERLWNVLFYALQDVVMRNLMWRELDKYYSEVKGTPTSACELMGKADIWLMRTYWDFDFPRPLLPNFKFVGGIHCKPAKPLPEEMEKFVQSSGDAGIVVFSLGSMVKNLTTEKANMIASALAQLPQKVLWRYSGEKPKGLGSNTRIYDWIPQNDLLGHPKTKAFITHGGTNGIYEAIYHGVPMVGIPMFGDQPDNMVHMEAKGAAVTAKLKFMTNESLRDAVNTVINDKSYKENVMRLSRIHHDRPMSPRDEAVFWIEFTMRNKGAKHLRVQAHKLTWYQYHSLDVLAFLLIIDLLLIFILFKSCSFCFKRCCSRKKTKRKAE

SEQ ID NO: 7478 - protein, 538 aa, Brugia malayi
MYHAEWYLASLIIIFHASQNDSYKILVYNPRFGKSHTKFLGSIADTLVNAGHNVTEFAPVLFEFSDSTGSKLAKTVKIDADPEISKIMNVEIFAQDAWKRNQQSIFSLISVMKRMSDALLKNCEFQLKQEKIMQELKSEKFDLAIFEFNQCFAGIIELLRIPAHIVVSPTALFEYAIECFGIPNIPSYIPSLLTQYTDKMTYLQRLKNLIITILTTKLLDNHTIRCQALFRRLYGDQFIDLKEKLAQVTYVLTNTDPLFHISRPTIHKMLELGGLALPKPQPLSKEWIAVMNKRKAVVLVSFGTVTLSCWMPNETKQALLDAFDSFPNVTFIWKYEKDEHLIAEGRPNVITSKWLPQSDLLAHKNLIAFLTHGGMNSITETLNRGKPIVVVPLFGDQMQNAVLVQRLGLGIKLSLSELAIKEKIKNAIYNIIYDKSYAQKVERLSKMMAKKPNQAEEQLIKHVEFAAEFGQIANFDPYGRKMSFVSYYMLDIIIPFIILIFFIITIICYLIIRLFRKLFHKAVICNNNNSIITKVKKN

SEQ ID NO: 7479 - protein, 527 aa, Zootermopsis nevadensis
MKREFQGQMAKSALWCLCLPVLLFLLLVPQDVSCARFLVIIPTSVKSHFLMLEKYMKALADRGHELVVVSRFPQIQPISNYVDIVLEGSLNGSNPKYTLSIEQALFIKNPVVNAMSLAKYGALNCGAVLNDPSVKQLINSDEKFDVVVNDCFHTDCFLPFAYKFGAISICASTSVLMPWANDRMGNPDNPSYIPNLFTSYSERMNFVERVINAVTTVLHKVAYHFISDCPSQLLARKFFGEDTPDLADLARNISLLLVNSHFSVNAPRPLVPGVVEIGGMHIPKPKPLPQPLQDYLDGARHGVIYFSFGSLLQAKSFPDDKRFLQAFSELPQRVLWKWEGDTLPGQPENVQIEKWCPQSDILRHPNVLAFVSHGGLLGTLEAAYNGVPVVGIPFYGDQRSNVAHLKARGMAIQLQYENITKQSVLEALRTVLDQPSYIENARRTARIFRDRPQSALDTAIFWTEYVMRHGGAPHLRSAAVELAWYQYLLLDVIAFTLGTILIFILAVRKFFRVLCSSKNVLVKKKQE

SEQ ID NO: 7480 - protein, 345 aa, Homo sapiens
RWTAPLRSAFSLLTSSSNGIFDLFFSNCRSLFKDKKLVEYLKESCFDAVFLDPFDACGLIVAKYFSLPSVVFARGIFCHYLEEGAQCPAPLSYVPRLLLGFSDAMTFKERVWNHIMHLEEHLFCPYFFKNVLEIASEILQTPVTAYDLYSHTSIWLLRTDFVLEYPKPVMPNMIFIGGINCHQGKPVPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQQSGRQM

SEQ ID NO: 7481 - protein, 530 aa, Mus musculus
MAPAVFPASLPLRVCLLLAFGLAQAGRLLVVPMDGSHWFSMKMVVEKLSHRGHEVVVVIPEVSWHLGKSQNFTVKTYSVSYTLEDLSHHFNFFAHKQWENREVGMFSLLKHSGKGFFQVLFSHCRSLFNDKKLVEYLKQRSFDAVFLDPFDVCGLTIAKYFSLPSVVFSGGIFCHYLDEGAQCPSPPSYVPRILSKFADTMTFKERVWNYFSYMKERAFCPYFFKTAIEIASEVLQTPVTMTDLFSSVSIWMFRTDFVLEFPRPVMPNMVYIGGINCHPGKPLSKEFEAYVNASGEHGIVVFSLGSMVSEIPEKKAMEIAEALGRIPQTVLWRYTGTRPSNLAKNTILVKWLPQNDLLGHPKTRAFITHSGSHGIYEGICNGVPMVMMPLFGDQMDNAKRMETRGAGVTLNVLEMTADDLENALKTVINNKSYKENIMRLSSLHKDRPIEPLDLAVFWVEYVMRHKGAPHLRPAAHDLTWYQYHSLDVIGFLLAIVLTVVFIVFKCCAYGCRKCFGGKGRVKKSHKSKTH

SEQ ID NO: 7482 - protein, 533 aa, Propithecus coquereli
MATGLQFLPMGLLGLLLFLNGGPCAEGEKVLVVPMDGSHWLSMREVVRELHARGHQAVVLAPEVNMHIKEEDFFTVKTYGFPYSKYDFENLLKEHIQIAFETQHFLNMFFKTMAILKRSSVFLYKSCADLMHNKTLLRQLNASSFDVVLTDPVYPCGAMLAKYLSIPTVFFLRFIPCHLDFEGTQCPNPSSYIPRSLTRNSDHMTFVERVKNMLYPLALFYICHVSYFPYASLASEVLQREVSLVDILSHASVWLFRNDFVLDYPRPIMPNMVFIGGINCVNRKPLSQEFEAYVNASGEHGIVVFSLGSMVSDIPEKKAMDIADALGKIPQTVLWRYTGTRPSNLANNTILVKWLPQNDLLGHPKTRAFITHSGSHGIYEGICNGVPMVMMPLFGDQMDNAKRMETRGAGVTLNVLEMTSADLENALKTVINDKSYKENIMRLSSLHKDRPVEPLDLAVFWVEFVMRHKGAPHLRPAAHDLTWYQYHSLDVIGFLLAVVLAVTFVTFKCCAYGFRKCFGRKGHVKKAHKSKVH

SEQ ID NO: 7483 - protein, 339 aa, Oryctes borbonicus
MTADLVVNRNTWSMMRLVFAIAGPSLCKGVLETETLKRLKQTTKKYDILITEFFATDCALGFSYLFGIPSVALTTSIALPWTSSFIGFPDNPSYIPNYFTPFRPSMTLSERVINTGVYVITKMGYDIFSMTESNIHAKEFFGSNLPDLEELASNVSLLLVNSHFSVHMARPTVPNFIEVAGLHIKQNYNLSKYFQMALETDLKGVVYLSFGSMLLTESFPEYKLQSLFQAFGKVPYKILWKATREKFAPSLDIPSNIQFESWMPQLEILCHPNVKVFVSHGGMMGTLEAIHCGVPVLGIPMFADQKLNIRTSAARGFATYVSYENITEESISEALNLLL

SEQ ID NO: 7484 - protein, 466 aa, Folsomia candida
MNHDKVKDLVIPELAEMLEYLISKFDINYRIQGLQPSSLFTLDPVSYAACQAVHRSPTFQAWVATIPSIDLIYSDTNPECAYGLAAKFGAKHAIFQTIPLSSKQFEVLGISSEAGSIPPWEMSDIPPLSFYKRTVGTFLPFIGRVQQLSLYRFLYKSLFVETLGLETPPELYDMEADISLLLINGNYLEDYARSLPPFVVKVPGMHIRENLEAEQLDPSLEAFISSSSDDTDGFIYISFGTVVNASNLPKSFLDIFFRSIEAFPTLQFIWRWKGPIPSPHPKNLLFTPWVNQQKLLSHGKIRGFITQAGRPSMQEAFYHAVPTIAFPILGDQDFNAAKYEYLGTAVCMDIATVTQPQLMIAINRTVTDTAWIGRVNRMASLARDVPITPVKMALWWTEFILRHTPEEINFLKPLGQQSDWWKRRELDVWAFVILFSVVVSLVIFRLTRPLRQSLWKMVKSLKSKLD

SEQ ID NO: 7485 - protein, 410 aa, Alloactinosynnema album
MRVLLSGYDSRGGIEPLVALAVRVRELGAEVRVCAPPDFADRFAAVDVPLVPVGQSLRAMVNAPTPPTAGGLPDRAAAVVAAQFDKVTEAARGCDVLVATGVMPAVAAARSVAEKLGIHYVYASFQQLTLPSPHHPPLAYPGHPFPEGETDNRVLWDHDARSIQALFGGALNTHRAAHGLAPVDNVRDYVIGDRPWLATDAALDPWLTPADLDVVQTGAWILPDVRPLPADLEAFLEAGEPPVYVGFGSMPMRGSDVALSAIEAVRAQGRRVLVSRGWADLGLIDDQDDCFAVGEVNHQALFSRVAAVVHHGGAGTTTTATRAGAPQVVVPQMGDQPYWASRVADLGIGAAHDGPTFTAESLSAALRTALAPETRTQAAAVAGWIGTDGATVAATLLLDVISRERPPVPA

SEQ ID NO: 7486 - protein, 427 aa, Thalassospira sp.
MHILLMTYGTRGDIQPFIALAYGLQQTGHMVTLAAPGRFQSLVQQHGLAFAPLTDALINLTSKPQFANASNPGTGFLKKISSILKLRAQGRDLQGALLDDIFETINRLRPDKIVFHPKAFGALAIADHFAIPAILAQLIPALIPTRAYPHIGFPNMADCRKYNLLTGKLVKGLVNLSLRNSLRDWASKRHKAIPYQKFDILKSQKFGAITILNAYSNAIIARPNDWPKKAAVTGYWFVNDALYEPSTEMTSFIKNSQKLIYIGFGSMPAANPQKTAQMLIDAVKQANAQAIIATGWGGIASDVDWPSNIYAVREVPHEWMFKHVKTAIHHGGAGTCAAALRAGCPSIIVPFFGDQPFWAKRLYTIGVAHQLIPSSKLDAKCLASAISDILATPQVHETAKRIAKQISHENGVATAVDLILNGTEIAA

SEQ ID NO: 7487 - protein, 605 aa, Vigna angularis
MAKENVLHRATSSSSDISVCLDTDATSAPASAGPVHRNPSYAERGTPAPTPAPAPVNGDNDLTRVRSKGSSAVALAKFLDAKVPFREKVQWIKRASVLKADGTVEIKVPGIGSSIHEHHVKCDEPHDEFWDAIHNQDIRSIKPLQIVMLIVGTRGDVQPFIAMGKRLQEDGHRVRLATHKNFEDFVLNAGLEFYPLGGDPKVLAGYMVKNKGFLPSGPSEIHIQRNQIKEIINSLLPACHSRYPDYNATFKAEAIIANPPAYGHTHVAEYLKVPLHVFFTMPWTPTSEFPHPLSRVKQPIGYRLSYQIVDALIWLGIRDLINEFRKKKLKLKPVTYLSGSYTHPFDVPHGYMWSPHLVPKPKDWGPKIDVVGFCFLDLASTFDPPKSLVDWLEEGEKPIYVGFGSLPLQEPEKMTKIIIQALEKTGQRGVINRGWGGLGSLAERKKSVYLLDNCPHDWLFPRCTAVIHHGGAGTTAAGLRAECPTTIVPFFGDQPFWGERVHARGVGPAPIPVDEFTLDRLVDAIHFMLKPEVKRRAVELANSMKNEDGVLGAVKAFYKYYPDQKSRCEEAKALAAVIKPKPIHKYFSLRGCLGCSTSSVDTHRP

SEQ ID NO: 7488 - protein, 859 aa, Aspergillus nomius
MTDMRCFAAEDGSWELPPPYEPISSSGGADSHPTRNNGAFPLSGASFPELSPTNDGRVDVHIGSRFSRNLEWLMGNQAAETPQTAGEVAPSVPCPAWDLHLNIVIQVVGSRGDVQPFVALGKELQKYGHRVRLATHSKFEQFVRTADLEFYPIGGDPVELMSYMVRNPGLIPSIKSLRAGDIQRKRASMADILDGCWRSCIEPDLYDKNPFVADAIIANPPSFAHVHCAQALGIPVHLMFTMPWTSTRAFPHPLANLKYSGNDPSLGNLVSYHFVEWLTWQGLGDLINTWRRNVLGLDPVPTSEGPNLVEALNVPFTYCWSPALIPKPKDWASHIDVCGFFFRDPPAYEPPAEIDAFLCAGPPPIYIGFGSIVLEDVEKMLSILLDAIQETGVRAIISCGWSNLERRETPNVYYIDDCPHEWLFQHVAAVVHHGGAGTTACGLRNGKPTTIVPFFGDQPFWGNMIAAVGAGPEPIPHKNLTARKLADAITYCLTPQVVAVAREIAHGMRQECGVRAAVESFHAHLPRRKMQCDLIPSEPAVWYFKTGRRTVKLSKIAAWTLKHQGRIQGKHLKRYQTKPFTIEARRWDPFTAISSASLSTLTGMADATAGIFIDPYKEYKRLRKSDRNRDASNPVIISYPPLAASETSSTTEPALISRTHASPDISDTEISPDDPAYARQMAIASATSLGIFLGRSSRGALVDLPLAAVEGMRAVPRLYGEKVRVHDPVRDWKSGAGVAWSTFSHGLYEGVTDIFVHTYHGKRKQGALGVAKGLTKGLVSLTVKTGAATVGLIAYPNQGIYRSLMSTVRKRPAKLIEEARWAEAEWTTRADGGVQINAAELCSLYDELLSTREAARRGR

SEQ ID NO: 7489 - protein, 1337 aa, Pseudocercospora fijiensis
ITSMDVPDRFKNDDDEKDVDDGTGVNEDDDNRPIFAQQSMYGIIAATRSKPDFQTSFQPDSESDSDEHSSTRRKSMDAPKRRKEKDAQKMKARSEPQKSAKKAEDISGWKDGRKSSEFKLARSFLKPMRERSDSQGQGHDPMTQSQFLPPRGEEHAETETGIEQAHTHTHAHAHTHALRSEAPVLDRKLEAMRKAEMQASMASSSSGRNRRDGRRSTDGKKRKEEQRPLPQVIADIFRFDAPEEVVAEFPCWYLQNVLLQGFMYITRKHLCFYAYLQKKTNTTIKHGRLGKLGKHSYRYRPYWFVLKADNFSYYRDSAEPYFPLGQVDLRFAISADLAEEKGTDTTYFTLTTPTRLYQYQADTPELAKEWVKQLQNVIFRSHNEGDAVKISLPMDNILDVEKSNVLEMASTIKVRVVDNEETFAIDEYFFTFFNAGDRAEEALRILRSHEPSPPDPVRPTLSPMSAGDSPSPRLSGAHRRASTKLRRGSSGSGSASFDTGRRSSSGQEGARRASKSPVSPSIQESSESFVTSSEQPDSSSHEDEEHDVDMSASQMLSDDHVFRGPTLRMPQPRRAVLGTGKHLQPESRDCSRSSSQEPMPVRLHPPSRQHTEQNDKPKPSDATAPKLIRGISTPLQYGMTVAGMVRSSSKRMGSYLSSSPKAYIDKWSDAIAGGKRQYISEEGMAPDDSIRDLEDGLDVVEHERRFREHFGLPPTEKLVSTFYCWLHKTVPLYGKIYMGTRRFCFRSLWYGTKTKLIIPYKDILNVSKQRGFRWGYPGLVLVIRGYEELFFDFPSNGLRDDCVVTVLKNLESLETAAQSTLLTQEEQQDAEDAAAENELLRDARTSSADHDFTDELRSAMSPILYDDPSASTAALKPKKSLRITCLTIGSRGDVQPYIALCKGFLAEGHKPRIATHATFKDWIERHGIEFAEVGGDPGELMRICVELGMFTPSFLYEVNTKFRGWLDDLLQSAWDACQNSDLLIESPSAMAGIHIAEALQIPYFRAFSMPWTRTRTYPHAFAVSNSKMGGAYNYMTYTLFDNIFWQTQQFQVNPWRRKTLGLPPTSYDKLQQNKVPFLYNFSPSVVTPPLDFSDWIKVTGYWFLDEGTDWTPPTELAAFIQKAREDGQKLVYIGFGSVTVSDSRQLMQQVVDAVLKADLRCILSKGWSDRFDRNKYAPEPEIPDCIYKIDAAPHDWLFRQVDAVVHHGGAGTTGASLRAGVPTIIKPFFGDQFFFANRVEDLGVGMHLKKVTANQLGKALWIATHDARMCNKARVIGEQIRSEDGVKTAIHAIYRDLEYAKSLIKKHPQRNSTDGPTEDEDDDLTEENWTFVEKEQE

SEQ ID NO: 7490 - protein, 453 aa, Melampsora larici-
SASQDTLNLGHQLSNIKPSGPLKVTCLTIGSRGDVQPYIALCKGLQRAGHVCTIATHPEFKQWIEAYGIKFASIGGNPKELMKHCVEHGILSFSFWRQGYSKFSGWLKELLHNSGEVARGSDLLIESPTTMVGAHIAESLQIPYYRAFTMPWTSTSEYPHAFAVPSQARGAMYNRMSYTLFDRLIWAGTSRFINHWRKQDLGLGPISYNALKAREHPFLYNFSEKVVTRPHDWKEWVHLTGYWVLNDSPKDVEHIPIEAQLPHGLESFIKTSREDEKKVVYIGFGSVIVPDPEEMTRMIAEAVKGADVHAVVSGGWSAKDSKVGAVGMKEQLKEFSDRIFYVDSVPHRWLFNQIDAAVHHGGAGSTGASLRGARETTIIRPFFGKFDYFRNFRAQRVEELGVGTNLHDFNAENLKEALKRATTDEAQITKAAELGVQLRSENGVNNAIQTIYR

SEQ ID NO: 7491 - protein, 859 aa, Rhizoctonia solani
MILTDDKTGSNETRSQAELSPRPSVQTNPFESASATTSPYVHASDSHESSHETAGQAPPTYSPSVSRTTRRTEMFITNGRPESTIDLVGASADSSFYPNEKVHLPEYQETIATEAAIQSDGRIQASFAPSYRLPEGYAPPIYEPALDEDGNVPAMSINIMIVGSRGDVQPYIALGQQLQEYGHTVRISTHEMFRMLVKNAGLMFFNIGGDPSQLTGYMDRNPSLIPGLDSLKNGDLGKSQQIIAEILDRCLLSCYAEDEASQGESGFAADLIISNPPTFAHIHCAEALGIPLHLSFTMPWSPTSAFPHPLVNIKQNDDAEPRMANYYSYGLVDMMTWQGLGRTINKFRTKRLGLEYLSTQSAVGITERASVPWTYCISPTIIPKPTDWMSNIDVTGYCFLNLAKGYDPPRELVEFIEAGEPPIYIGFGSIALENSENVTKSVLAAVSQAGVRAIISTSGGGLDQGMVRDAGEGVFPLTGDVPHDWLFERVCAVVHHGGAGTTAIGLKCGKPTVIVPFFGDQPWWAVQVVRRGAGPPPIHPNKLTAEALAVAIRLAISPETRDAARQIGESIRNEKGSKKAVESIHRHLPLLNMRCDLDSNRVAVWYSPTHKLRLSAFAAQVLAEAGEIDINKLELHRSREYETHIGPIDPVSGTILPGLKILNDFGRGVAKLPSQPGKGATKMLSASTLGVQNTFRGAAEGMHNLPKVYGGEVRKNKKVTGLGSGFAQGGKGFALGLYDGFSDFFMEPVRGFKRGGVLGAIGGVGIGALNLTTKPTAGFMQAVSMPIEGAVKEVKSLLYRQVGKDRIATRYAEGVNAARNASEGEREKIVRAFVERVSGSDTLTVDKKGKGKAKMVWKN

SEQ ID NO: 7492 - protein, 1191 aa, Punctularia strigosozonata
MATVRLKRRARLADKLRDVFELPGINEVVAELPCWLFSRSVLLQGFMYLTNAYLCFFAHLPAKEDQVLKSGSLYKKAQRTKRWIKHWFVLKNDVLSWYQSAADPYFPHGVADLRYALSCEPHGEKELRIRTNAKTIHLSADSARQRDDWAKAVRRAMFKSQHEGAHVKVAVPYGLIVDVDKSRAMDWTETVEVKVLEGGVAMDSYFFAYFKDIDGALEQMRDVVRTYRPAVEGGSGSGTAQIMDTTVPRAPASSPQDAPPRPSLDRAGELSPSASTSSSRMSAAFRLSSLWKPISDSLPLVRSPVSAGASLEPQAGERPDEFMHIKKGSSFVPRTAAPRSMTTDPGVHARAHAHAVPGMMGERSVSEGAAGLARSEHTYPPGTLAVEAEPAPSPTWSVGVPSWLRVPGRRAPTSPASAAVVAGSVAGVKEVYATSGGRHRSTGSAGSGAELGYSVLDPGAGVDPEMRDKFRTYFAFDEKETLLGYFPGYIYRVLPVYGRLYVRVKTTPARSFAVLTRYQMILPIRDILSTEPSKAFHFGRYGLVMNLKGYEELFFEFGVEDRRSAFVRLLERQMEDVRSRAQLAGAAGQQDTRDALIFEEYDSRQSSSISSGSDMRGSTDAAVTESLPAHMFTSASSTFLTFKPKESLHFTFLTIGSRGDVQPYIALAKGLMADGHRVRIATHGEFKEWIESHGIEFGYVGGDPAELMRICVENGTFTVSFLKEGLLKFRGWLDDLLKTSWEACQGTDVLIESPSAMAGFHIAEALRIPYFRAFTMTWTRTRAYPHAFAVPERKMGGGYNYMTFVMFDQVFWRAISGQINRWRRKTLGLPSTSLDKMEPHKVPFLYNFSPTIVPPPLDWPEWIRVTGYWFLDSAEVSAQKWTPPAELVQFIDSAHQAGKKVVYIGFGSIVVSDPKGMTRSVIEAIVRSGVYAILSKGWSDRLNAKTGEASEPEEPLPKQIYQINSIPHDWLFQRIDAACHHGGAGTTGASLRAGIPTIIRPFFGDQFFWADRVEALGVGAGVRHLTSESLAQALIAATTDEKQIQRAKVVGERIRAENGVGTAIEAIYRDLEYARSLIKRRADEDVGSDAENATIRESLEALPDPQSPESVASSYGSGPRASSDWSVISGDDGTPSSLTSRRSSYGGDGRLDRPQLPKRNSLAAAVLSVLPSPAAIRPRTPRSTSSPSPSR

SEQ ID NO: 7493 - protein, 1881 aa, Talaromyces islandicus
MHRLVNALFLIWIAFGVDANSQIPLQSKTETEPHQFLGAGSAGASAAYYLRQFADDSDIPLNITVFERSHYVGGRSTTVNVFNDPKYPVELGASIFVSVNYNLMEAAKKFNLQISSTLQDRPRQSLAMLGIWDGERFVYTQSHSMTWWDTAKLLWKYGLAPIRTQRLTKQVVGKFLNLYKSPYFPFSSLSSAVVDLELHKATAVTGAQFLEANGISGSFPREIIQASTRVNYGQNLGLIHGLETMVCMATDGAVAIENGNWRIFSGMLGASGAKVALNTTVTSIDRNEDDTVSISHQGKDGISSISIFDDVVIAAPYQASGIDISASLGQAPDKIPYVRLYVTLFASHHQISRRYFNLSDQNEVPEMILTTLPENLDLGSHEDGVGPTGFWSISLLRVVEAPAEDPDHKHHYVYKIFSPKRLSAEFMASILGLDIPVAGKNATIGDLPSHDVSWFHEKTWDSYPYEYPRQTFEDVKLASNIWYTGGIESFISTMETSSLMGMNVAGLMVNEWHEQTGRQFVFKEQYNSMAFREDAGKARSKNRKFSLSKSLHHLPSQSVPDRLKDNNDEDDQEDVMAPPKSLGDQDLPYMNRSIFSMITAAGSRSSFHSRFDDSSDSDGGEVTKPARVDLLRKQAARYKPARKESGTSLSQPIPEESEQQTQSPSDEGTIHRTSSSKSRPRSIASRKSSKGKQPSDDINEPGTDENESPLPPAQETESTTPRSAPVLSRMIEAQTRFDTSALSSEEHAHLEKEECGRSSELEKSTNLLSIRLKEIFKFESPERVIAEYPCWLMQSIALQGYMYVTEKHICFYAYLPKKSNTAIKSGYLSKRGRKNPKYNRYWFSLKGDVLSYFADPSNLYFPSGHIDLRYGISASLSENPKDKEGRDFTVTTDHRSYNFRADSAASAKEWVKALQKVIFHSQNEGGRVKISLPLENVIDIEQSPMMDLAETFKIRVVDIYETYAIDEHFFSFFNYGQDAFDVLKGLINDTAQKDTEKPLALNDIEQARQRSDSGTSEFVKSRAGSESRRKSGISDVIAQEQNNDSESFVQSLGHGTESSISLQSQSDTVVTASQILNRSDVFQSPTINRLHRAPSAPGDASRKAKEGKISPQHGFDGPVSRQGRSLGLKAGELEQKGDSESEVYSSSAPSIHEIVKVGAYPLQRAAGFAEYLRSRSRQMSSLLATESMGYIEKVSGMWAGAGKHYIDGDDPITDRYIDGADAETNASYGDRFRAHFALPASEKLQATYYGYLHRVLPLYGKVYIGNSKFCFRSLLPGTRTKMILPIKDIENVEKEKGFRFGYQGLVLIIRGHEELFFEFNAADSRDDCAVTLHHRLESVRFLEQSSILLQKDVDEADAAKTEQQLLRDARNGPSPETSLEVHPIFDDPRASIINFKPTESLRITCLTIGSRGDVQPYIALCKGLLEEGHQPRIATHAEFEPWVRKHGIDFAPVEGDPAELMRICVENGMFTYSFLREASLKFRGWIDELLSSAWVACQGSDVLIESPSAMAGIHIAEALRIPYFRGFTMPWSRTRAYPHAFAVPEHKMGGAYNYISYVMFDNVFWRAISGQVNRWRKIELGLRSTNLDKMQPNKVPFLYNYSPSVVPPPLDYPDWIRVTGYWFLNEASGWTPPIELTRFISQARADDKKIVYIGFGSIVVSDPAALTRTVVESVQKADVRCILSKGWSDRLGDPKSARVEVPLPPEIHQIQSAPHDWLFSQIDAAVHHGGAGTTGASLRAGVPTIVKPFFGDQFFFGSRVEDLGIGICMKKLNVSVFSRALWEATHSERMIVKAKRLGEQIREENGVSNAIQAMYRDLEYATTLTRQRAAVSSTPYTPTGGDEQQGLDGESEENEAWTFVDDDTNFEQFKRGQDLPRDDLF

SEQ ID NO: 7494 - protein, 1260 aa, Trichoderma atroviride
MAPDENQRSRPKRQPSTRTPPRRRDRAASEALVTDGFVLPALEAPADAPPAYGNHHDQLQFKRSGFDAEAAVTGDGRINININTKNHRLAELLAPSIANQIAVTVQPTRPPVYTLPSLAGEPGKQPPPRLNVVIQIVGSRGDVQPFVALGIVLKEKYGHRIRIATHPTFQKFVEENGLEFFSIGGDPAELMAFMVKHPGLMPGLDALKSGEIGKRRRGVQEMLLGCWRSCIEAGDGLGPPPEPHRKLEPWDPDAGMPGDPNHEPFVADAIIANPPSFAHVHVAEKLGIPLHMMFTMPWSPTRAFPHPLANIQYSNADDVLTNYLTYTLVEMMTWQGLGDIINRFRESALDLAPLSLIWAPGLLNRLKISYTYCWSPALIPKPNDWGSHIDISGFYFLNLASSYTPEPDLAAFLEAGPPPVYIGFGSIVVDDPNAMTRMIFDAIHLAGVRALVSKGWGGLGADAVGLPDGVFMLGNVPHDWLFERVSCVVHHGGAGTTAAGIKAGKPTLVVPFFGDQPFWGAMIARAKAGPDPIPYKVLTAENLAEAIKFCLKPETQDQAKALGHRIREENGTEAGSRSFHNHLDIDSLRCSVAPSRAAAWRLKRTKVRLSPLVAAVLVKQGLLKYTDLKLYRPYEYNTEDQPPDPISAGACSLVTDISDIGMAIVDMPLDILKSPKKARESLKDSGSQASGDDSDTGSKRTSTLDRPGVKSPVRTSGESAGETSATTGQLTQFPTLPTQIGRTRSPTVESQGSRSSSRRRALSAAATMEAAVGTTKNVGRIVSTGVKSPMNFCLGLAKGFRNIPRLYNDDTVRSIEKVTDFNSGVRVAGKEFGFGLYDGISGLLTHPMRGAQKEGAAGLIKGVGKGIGGLIAKPAAGFWGLPAYVMQGAYAELNKFLSRSVQNYIITSRVVQGERDLQNASEGEKADIIYRWNHDSDLKTIQETKLRGQDREHSRVGSGGGPTSWFPTLQDGRRQMGAALEEKPRRQRSRSGRISRGFSLSRSSSPAPVNWEESLNTDAEFEEAIMASVRETSRGNDEEDAMVEIAIRESIMAMQQQGSSLPDPVRLKTEGSKNSADVFEDEEYKITDEEYQNLIEQAIRESLAGHEKELSVLPGSSSRDLDVKFAQTDEPRSSGSAFTPNTDEDTDLQRAIVESRKVPPTLPPREKEDDEEEHFRRAIEASMNEMERIKKEKTEEEIVMEYVKKQSLAEDEFQKRKDSKGKGKEVSEVASNASDDEELKRAIEESLKMNGGDGDGPSGL

SEQ ID NO: 7495 - protein, 1125 aa, Zymoseptoria tritici
SRAAKPKNGHRKRLSENKLVRKVLRPVRERADSQDLMTQSQFLPPRKEMAEDREKQRISPSRKKSSSATDLKREAAKPSSPITIKQSRERSESPEAPMVHEEIDDEPKSLSTVLAQMFQFEQEEEVIAEYPCWYTVNVLLQGKLYITGKHVCFYAFLPKRHNKIIKTGHIGKVGKHSYRYLRYWFLLKGETFSYFKDSHDPYFPLGVVDLRNGISADITTKAGEDTTEFTLTTQTRVYKYKADTPGSAMEWVKQLRKVMFRCHNDGNAVKISLPLENIVDIERTGVVKAAETIKLRVVDNEETFAVDEYFFTLLQSGDEAWNVLKDLTDGNNAKQMGSDAALQDAHPFGKTKSQKSEKSASLDKDRYLVAEPVRTTLSRPNIRAPSSPRRSIEQQRSSTEASRRHSGETSRAILHRSESSGSIKTLTANDKPARPTQGLMIRGISTPLQHAMNVAGMVRTTSKRMSSYLSSSPKDYLGKFSGALAGGKIQYDEVEGLTPDDSVRDTDRDASGLTAEDRFQRHFGLALTEKLTCAFYCCLIKTVPVYGKIYMGSRHFCFRSLFYGTKTKIVIPYRDIINVQKQRGFRWGHPGMCLIIRGYEELFFDFSNKGLRDDCAIRSLRILDAMRNSAEDPALLTDDELQDAAEAAAENNTLQTAKKQNLNTNELQMAVDATNDDPDAPPILFDDDLSSSMLDFKPKEPMNITCLTIGSRGDVQPYIALCKGFIAEGHRASIATHAEFGDWVKSHGIEFKEVAGDPAELMRICVDNGMFTPAFFMEANSKFRSWLDGLLITSYEACKGSDLLIESPSAMGGIHIAEALQIPYFRAFTMPWTRTRAYPHAFAVPGRKLGGVYNSATYTIFDGVFWQAMSGQINRWRRHTLDLPPTSLSRLQQDKVPFLYNFSPSVVAPPLDFADWVKVTGYWFLDEGTNYSPPPELADFISRTRAEGRKLVYIGFGSVTVADSRQLMQQVMEAVRKADVNCILSKGWSDRFSKASSTPDAPLPDYIHQIRSAPHDWLFTQVDAVVHHGGAGTTGASLRAGKPTIIKPFFGDQWFFANRVEDLGVGSHLKKVSANQLGKALWVATHDARMMEKAKVLGEKIRSEDGVGEAIKAVYRDMEYARSLV

SEQ ID NO: 7496 - protein, 409 aa, Streptomyces sp.
MTAGSRGDVAPFTGLGHGLARAGHAVTLVTHGCFEPLVAGSGLDFHALPVDPRAELESTRGRGLHRSATDTGKMLRAVGLVRAALARMTDDLVAAAEKSDVLLLSGSLGPVGHAIAEALGVPSIGTHLQPLSPTREFAPPLLGGGHWGAAANRLAGHGVNLAMERVFSAAVPTVRARLGLPAARRGTARRIRAGLRQPVFHGFSPLVVPRPRDWRPGLRVCGYWWPYDREDGLPAYVRRFLDAGPAPVFVGLGSATVPDPARLSGTIVRALRLAGLRGVVQRGWGGLAATGEDMLTIDEVPHAALFPRMAAVVHHAGAGTTAAGLRAGVPAVPLPVQFDEGFWAERLVSLGVAPHAVPLRGLTANGLAAALARATRNPLHRERAETLGARIREEDGVAPVLRAVDLLAR

SEQ ID NO: 7497 - protein, 615 aa, Arabidopsis thaliana
MASNVFDHPLQELEGEDNGVKSEKASLLETSGSVDTTPEDSGHRSSDGHRGLDHCETAPVGLYGDMLINDSEIQYSRSLTEKGSPAIHNLKLDRLSEQEKQKLIVELVRIQNDGTVEVIDNGTPVSELWEFEPTKGQSTITYEKSLTESFRSIPRLKIAILVVGTRGDVQPFLAMAKRLQEFGHRVRLATHANFRSFVRAAGVEFYPLGGDPRELAAYMARNKGLIPSGPSEISKQRKQLKAIIESLLPACIEPDLETATSFRAQAIIANPPAYGHVHVAEALGVPIHIFFTMPWTPTNEFPHPLARVPQSAAYWLSYIVVDLMVWWSIRTYINDFRKRKLNLAPIAYFSTYHGSISHLPTGYMWSPHVVPKPSDWGPLVDVVGYCFLNLGSKYQPREEFLHWIERGSPPVYIGFGSMPLDDPKQTMDIILETLKDTEQRGIVDRGWGGLGNLATEVPENVFLVEDCPHDWLFPQCSAVVHHGGAGTTATGLKAGCPTTIVPFFGDQFFWGDRIYEKGLGPAPIPIAQLSVENLSSSIRFMLQPEVKSQVMELAKVLENEDGVAAAVDAFHRHLPPELPLPESSSEKKDEDDRPDLLQWFFIQIGKKCCLPCGGV

SEQ ID NO: 7498 - protein, 432 aa, Catenulispora acidiphila
MKVGIVLFGSRGDIQPYAALAHGLTAAGHEVVIAANADAAPIVDAVGVRFVPVAELDIRKWLSSPVGQEALMAGTAQALLDSANAWIVSALPSLVAATKEVADGADVVISGFPMDDYVAAVCAAQGVPMIIGYLTPWLPTKEFPPAYMRVGRPDPELLSGEDNLRTYQEFEEIFWRGRREAVAELRASLGLAPVDRPLLQTAPDLGYTVLHAYSPVVVPTPQDWGQGNVFTGYWRLPAAARERLGEAVPPAELVEWLDAGTPPIYLGFGSMPIMDPAPVLRMAAAAAERAGVRILIGAGWTDMTEAAAGLPDHVAVVNEVDHDWLFPRCAAVVHHGGAGTVAAGLTAGRPSFVFSMFFDQPYWGAQIARLHAGGGRMLTEMDLDTLTEAMVLLGDGHVRGHAAEIGDRLRQEDGVAAAIKVITDPARAVIPR

SEQ ID NO: 7499 - protein, 1587 aa, Magnaporthiopsis poae
MESSDGANRRSAPPPPLAPTSAQPAAVSPPLVSPPLRRGLSSRQPARASIDRHPRPSEDDAKKRARKLQKKRVHTPHSPVMEIPERLRESDPEDEDDANRRPPFNMNQSIFGLIAAAGSAVDFNDRFDRASSDEEDEDAPADDDESDSRGRFGMAQTTVFGGKKPPKDSPNLEVDKKRRRTSGSKLLRSLPSLSMPKRLSSLSRKNKASKAKELQIAEEDEVDSPTSPAVGDFHAASHADGRLPPVMTRMLEARAELSASRPSLDLEGTSGSNSPVSGESRPSPLARKLKQIFEFDTVEDVIEEYPCWLLQSVLLQGYMYITKNHICFYAYLPKKANEVAKSGYLSKSGKRNPKYNRYWFRLKGDVMAYYRDPSNLYFPSGQIDLRYGISASVTDKDKDGVNFTVVTHQRTYHFRADSAPSANEWVKSLQRVIFRSHNDGDSVKISLPIQNVMDVEEMQLVQFAETCKIRVIDNDETYAIDEYFFSFFSFGKEAINLIKILTDGAGGTQKPDDPAHGLPETPTDGVPSRNPSTKRNSMSGSRERRPARLNDTVRATLSPMGATSPPNPSPRASGDFTRSSFDALRTFGRRSLDLNTAVTMREESQERRSFSGTRHARSRSRHRLGEQSTIPEKQESSDSYVQSINEDPSQASLSALVTSSSEDQSASQILRGSDVFHSPTVRRSPSESRPKGATDSSAAGNQALTQTSQWSPPIKIDRAAATGSRQDTGAGLGIQQGPPTPGMQGLANMASLPVRSAGALAGYLNRPLSPFRRMSNLLATESMGYVEKVSGMWKGGRRHYDENSALKMDDELPEDDDEDKVATSRERFRQHFALPESEKLVATYFGYMLRVLPLYGKIYISDRSFCFRSLLPGTRTKLILPLRDVENAHKEKGFRFGYSGLVVIIRGHEELFFEFGQADIRDDCTITLLQQLEEARYLRDSGLLCQEEKEDAETAAAERDALQEARQEEHPEHEIPLPRQTSVVSDAPTILFDDPKASFLNFKPPQPLRVTCLTIGSRGDVQPYIALAKGLLAEGHQVRIATHAEFEPWIRSHGIDFARVEGDPGELMQLCIENGTFTWQFLKVAASKFRGWLDDLLSSCWEACQGSDLLIESPSAMAGIHIAEALQIPYFRAFTMPWTRTRAYPHAFVMPEHKMGGAYNYVTYVMFDNMFWKMTAQQVNRWRNHMLGLPNTSLEKMQPNKVPFLYNFSPYVVPPPLDYSDWIRVTGYWFLDEGTPNKAAAEVKPGEGGEEDDGSKSKQQATKASGADWTPPRELTDFIDKARRDGKKIVYVGFGSIIVPDPAKMTQEVIDAVLKSDVRCVLSKGWSDRVTGSSEAKPSADGAADSKEKAKDKTEGGDQQESVETPKEEPKLPPEILQIKSAPHDWLFAQVDAVAHHGGSGTTGASLRAGVPTIIRPFFGDQFFFGARVEDLGVGICLRKWGTNSFARALWEATNSDRMIVKARVLGEQIRKESGVETAIQCIYRDLEYATSLIKAKASKNAKHQKTQQEDGTTDGDDEGDDDETEEWTFVGGNIPDDGISSPRAGTFPDATAGGSVGKKSPSIAATSTSMARSSSRKSLSRVLGGL

SEQ ID NO: 7500 - protein, 1213 aa, Rhizoctonia solani
MASRQDDSASSSRSSSLNRGDELSRRSSTWSSSLDPSNGATSAGQPSLFRILNAAAQYSQLILHEDSSESDSDVVETPASDSAADAQIGLAENDNKQHDAYPSPETALANLALHPHVRPQAGSVTSLQRFAQYATGMTPEIRPKDIRDIKEGINQEGREPIGCDSSKVSDHAVALRILQHEFGELTLPGEVEEMLLETDAALFRDVTILGVIHLTTHRITFHASLLPGTNRDPPGGSTFSHDSHRSADSQILKAGPGVVIEPRTGILHPQKRRRVWIELSHDMITSYPDASDEGRVRPIRSILLSNVKEIDPYDPTQPNRVRMHMSVLGLDVTGDVELDTEESAHEWRRELSAALYMYRHHRKTLIGHGNEKIAPRPEDAQTESRGVRICIPLALIKEYQHEWWAAWACILSVAVEHRASPAGVRDIVPSGGLDNAVKSVLSAVAPFGSELEQLAQVTMPKSTKRESFTGLFSPATTQVPTLSPVTSISTDSSSARETTTSSHVPTSPGPWLQTSPSSSESEGLSQVLHLSVLQGDEKWYQFDNLIKARRENGAPPNAQVVLDWGELVFDEHTGSEHGSEPTREVKVEASASNEMSSAERKIRRLFAIDDQQKVWIARCRVCRTISSTTYFVITDRFVCYWAKSFGTHDTRYRFPVSSVRGASTAYVYAPLIYGLRLQIRGQHDLTFEFNSRELRDEALAKLKAIADTNLASENGPTTTAGSEVSSPRIERPSPLTVPEFSSTQECVSNAPALFSPLSRTMRRAQSVHIPPALVSRFPKPINLPPSTMVHIPPKHFVCLTIGSRGDVQPYIALARGLMAEGHRVTIVTHEEYKEWCEGWGVAHRTAGGDPGALMKLSVENRMFSPQFFKEGLTNFRDWLDELLLDAWKQCQDADVLIQSPSAMAGAHIAEALKIPFFHAFTMPWTRTNDYPHAFMTPPVEISGSFNYSTYVVFDNVFWQATSGQINRWRRKHLGLPSTDMAHLAQTKIPFIYNFSPAVVPKPLDWKDPITISGYWFLDDADLNWKPTQELTDFMNKARQDNKPLVYIGFGSIVVPNPKAMTRSIVKAVLKSDVRAILSKGWSARMSKETGPEVELPPEVFSVDKIPHDWLFPKVDAALHHGGAGTTGASLRAGIPTLIKPWFGDQFFWATRVMKLGAGLRVSSLSSSDLAEALKRAVSDRVMKEKAAAVGEKIRSENGVANAIRAIYTYLPRA

SEQ ID NO: 7501 - protein, 612 aa, Trichophyton tonsurans
MSRAFWRLCELLAHQGHQELPTTFPPETEEELQRLYDQVSGRQRSRSTGGGENEVGATAEMGSNSGSGLAEGNANDTFDTQTLKSSISNLSQDNSPMFFDDNSASIINFKPTEPLRITCLTIGSRGDVQPYISLCKGLLEEGHKPRIATHKEFEGWIREHGIDFAPIDGDPAELMRICVDNGMFTYAFLKEASENFRGWIDDLLASSWKGCQDTDVLIESPSAMAGIHVAEALGIPYFRAFTMPWTKTAAYPHAFAVPDRNLGGTYNKLTYVVFDTVFWKAISGQINRWRKNQLNLKPTSLDKMQPDKVPFLYNFSPSVVPPPTDYLEWVRVTGYWFLDAKPDWTPPEDLVAFISKARADKKKLVYIGFGSIVVSDPAAMTRTVIDSVLKTGVRCILSKGWSDRHGDPRSSQMEVELPPDIYKIDSAPHDWLFAQVDAVAHHGGAGTTGASLRAGVPTIVKPFFGDQFFFGIRVQDLGVGICMKKLNSATFTRALWEATNSQRMIIKAKQIGERIRQEDGVGKAIQSIYRDLEYAKTLTYLRRSAAGSPTNEGIEEDNNGDFLDGIEESWTFIGDDIFTKAQDPSSDLSTMMDGAAAGTLPPPDDDEDDVAC

SEQ ID NO: 7502 - protein, 1467 aa, Colletotrichum sublineola
KRVGKKLLKKRFETNTPAIELPERLKEGDDSREEDLVPTQGPPMFMNMNQSIFGLIAAAGSRVDFHDRFESSDDESADDHDHHDRHRESADDKTRGLGHLLHRKQRRPDTQQQPDLSKTTVLKKDSSSKSEKHRRKISGSKLLRSLPALPRLPRHKSKKEKSKPQSPSEEASHASEARSTQPANHIREEEEAEEEEEEEEEDEDEDDRDQRLAPVMSRMLEAKAEMSARPSFDIERLSADQLTYSDSAESNSNALARRLQEIFEFDHPEAVIEEYPCWLLQSVLLQGYMYITAKHICFYAYLPKKAHEVVKSGYLSKSGKRNPKYNRYWFRLKGDVLAYYKDPSNVYFPSGQIDLRYGISASVNDKKDGLAFTVVTHHRTYHFKADSAPSAKEWVKSLQRVIFRSHNEGDSVKISLPIENVIDIEDTQMLEFADTCKIRVIDNDETYAIDEYFFSFFSFGKDAINVLKILIEDASSNAKDAAKLKAAQGQEEKQQQQQQSSVAASARSSMSASRRPTAPLKLRTNKLPDAVKATLSPLSPHSSSALSPRASMDAAHASFDAFRGFRRRSLDLSTIMRDSSPRRSFSGNRRSMSRNRLDESRHAPHKQGSTDSYVQSSMEDPSYSGMVASSSEDPSASQILRGSDVFQNPTMRRSASASLTELEENRQREPRSPPALAAYSGQHAATTGSINDGDKPPATPTLQSISKMGAFPLQRVGAFAEYLNSTRSKLGSMLATESMGYVEKVSGMWRGGRKHYDAPPEIKTDDEDLYEDAEGKIQTSMDRFRAHFALPETEKLQATYFGYILRVLPLYGKIYISDKSFCFRSLLPGTRTKLILPLKDIENVDKEKGFRFGYSGLVIVIRGHEEVFFEFGQAELRDDCAVTLLQSLETTRYLKETGDLDMEEKEEEENAMAERDALKEARQVDEFHDHELRLPKGSTGVSDAPTILFDDPKASFLNFKPPHSMKITCLTIGSRGDVQPYIALCKGLIAEGHKPRIATHAEFKDWIEGHGIEFAKVDGDPGELMRLCIENGTFTWAFLREANSMFRGWLDELLVSAWEACQGSDLLIESPSAMAGIHIAEKLSIPYFRAFTMPWTRTRAYPHAFVMPEYKMGGAYNYMTYVMFDNIFWKATAHQINRWRNNTLKLPNTSLEKMQPNKVPFLYNFSEYVVAPPLDFSDWIRVTGYWFLDEGSDFQPPKELTDFIAKARADEKKLVYVGFGSIIVNDTAKMTQEVIDAVLKADVRCILSKGWSDRVAKPEDAGGAKKDEPVMPPEIFVIKSAPHDWLFSQIDAAAHHGGSGTTGASLRAGIPTIIRPFFGDQFFFGGRVEDIGVGICLKKWGAVSFARALWEATHNDRMIVKARVLGEQIRSEHGVENAIQCIYRDMEYATSLIKRKAGKHAQAEEDEEEEEAEESWTFIGSDEPDPDMTTKKLSEMGGSPGLPEPKPLGNRVMRVSPSASQQQQQAV

SEQ ID NO: 7503 - protein, 624 aa, Vigna angularis
MMGSNEIQCLTQEVSEGVLDGRQKNDLKKMEIVKSQGEDEKFGGASSEDDESVQVSSSSRRGLEHCITAPVGAERNPLIVDDKFMISRSMTEKSGFPKRDTILDRLSERAKQLITNLVKIQNDGTVEVDLERSASVAPELLELQSFEESTVSGGFGSESKKFVPRLQIVILVVGTRGDVQPFVAIAKRLQEYGHHVRLATHANFKTFVKSAGVDFYPLGGDPRILAGYMARNKGLIPSGPAEISVQRKQLKAIIDSIPPACTAPDMETGVSFRAQSIIANPPAYGHVHVAEALGVPLHIFFTMPWTPTYQFPHPLVRVPQSAGYWLSYIIVDLLIWWGMRRIINNFRKSTLKLAPIAYFSMYRGSISHLPTSYMWSPHVVPKPNDWGPLVDVVGYCFLSLASKYQPREDFVRWIKKGPPPLYFGFGSMPLEDPKGTTDVILEVLRDTEQRGIIDRGWGNLGNLTELSDNVFLLEECPHDWLFPQCSAVVHHGGAGTTATGLKAGCPTTIVPFFGDQFFWGERIYQKELGPAPIPISELNVENLSNAIRFMLQPEVKSRAMEIARLIENEDGVAAAVDAFHRHLPDELPLPTPSLVEDEDLNPLQWFFLRLGRFCCAPCGGIFGA

SEQ ID NO: 7504 - protein, 375 aa, Pseudonocardia endophytica
MRVLLATYGTRGDVEPVLALAVQLQELGATVQVCAPPDVELVAVAERSGVALTTFPKPWRSSETAPTTAEERVVDPSEFVTEHIDITFCPLLEAAEQNDVLLASGMLHFVARSVAELTGIPYRFVVFAPVLDLPQRDAVIGPPINAHRSSLGLATIDDVRSLLFTARPWVAADPTLWPVSEPSSVVRSPAWILPDDRPLPPGLEAFLDAGEPPVYVGFGSMRVCEDAAAAATTAARAHGRRTILARGWSGLSAIDDRDDCTVVGEINQQALFRRVAAVVHHGGAGTTTAAARAGAPQVVVPQAADQSYWAARVTELGIGSTHHGARRTTESLSACLDIALSPETRRRADALSDLIPVDGARTAARWLLEFAADRT

SEQ ID NO: 7505 - protein, 840 aa, Colletotrichum fructicola
MLEDDTVPQDYLPSYETAMAESMRQQRNSVNSDGRIDVNLDSRLATTLARFVPDFKDPSIAAATAAQGPPPEYVEAAARFADKKNFPVKLNIVIQVVGSRGDVQPFIALGNELQTYGHRVRLATHDVFDSFVRKSNLEFYPIGGDPSELMAYMVKNPGLIPSLKSLKGGDIQKKRKMVKEMLEGCWKSCIEPDTLTGRPFVADAIIANPPSFAHVHCAQALSVPLHLMFTMPWSSTRAFPHPLANLKFGEKGVVDQSTANFVSYSIVEWLTWQGLGDVINEWRKTIDLEEVPFSEGPVLAEVQKIPFTYCWSPALVPKPEDWPAYIDVCGFFFREPPQYTPPPDLAEFLAKGPTPIYIGFGSIVIDHPEEMTKTLVEAVRATGVRAIISKGWSKLGGIEADDVFFLGDCPHEWLFANVAAVFHHGGAGTTACGLLNGRPTTIVPFFGDQPFWGDMVAIAGAGPKPIPHKQLNVENLSEAIRFCLTPEALTAAGELAAKMRTENGVATAVKSFHANLPLEDLPCDIFPDQPATWEYKRGKKHVKLSKKAAGILLDHLKIGQKNMSPHDTRSIIIENRRWDPVTGASSALLGAATGMFKGATDIVVKPVQTYHERSKMNLAPPSSEALERPRSAGPGSSSGSTSASGSTTGAVLKASASGVGGFFKAYGKFYLDVPLAVTDGLRNVPKLYGEKVEQRKPINDWKSGTIEGGKHFVVGLSEGFADLFVQPYKGGRDGGAAGAALGVGKGVLNMATKTASATLGIVAYPGQGIYKSIRTAVHSKTRRNIAAARQAEGEYLASNSSFEVQAVLHRFDTLCRISEEKKEKKGRKSDEPELMERQTY

SEQ ID NO: 7506 - protein, 1387 aa, Verruconis gallopava
MDLPERLREGSDEERDICAPCHGGVNLNQSIFSLIAAAGSAAGLDEIANDSEEDGSHDGTSLSQTVPALQPTAAGILMNETSQAESFQHRRRSSKAKLIKSINKLKMKPLRGRKGATATNDIMSSSQILQPRQEQEYEEDIEDATLANAPHLSKILHADIQMRKELGRAHDGQRTAQDLLQPSLSLAEQVQKLFKFKEKQDIIAEYRCQLVQNVNVPGYIFVTKRYICFYAYLPHMTSKVVKTGYISKRGMHDPRYHRFYCELKGHVLSFYEDPAQINYPRSLIDMRRAIGVFATRGEKGKDETHFTLETDKRQYQLKADSVESATDWLRVLQQELLNTHNNGGLIKITLPIDNILDIENNYIRGMAFSESLRIRVIDNDETYAVEEYYFTFDSHAQEATRVLKLMVQSHDEPNDSDMSGSEERSSGRHSLVERPSAVPAHTPPLRESVRSTLYPHSPEIRAFSGSRISTGSRKSSLEVESSMELRRRSNDDDNDDGRNSVPISGRCKRSPASPTPGDSQESPYSPTMTSADQDTESSAAIQSLDETIDDTNASESQILNRSDVFQVPTLYAPSPKKPRTETDVAVPQRASQDTERRKARSPSDERLSVPKRPAAISRAVWGELTQYQHDAPKMINSSYSIGRLMKAGMSPLQSASGIAGYINKQSKQMSSLLATESMGYYEKVAGMWHGGSRHYASPHGMRLDDNVPDKQEEEQAMKDAQRFREHFALPESEQLLASWHCYAQRTLPMYGKLYLGSTHLCWRPLMARTTKMKLPLKVIETALKGTSYRLGYAGMCLVVSGDEEVFFDFNNVGLRDDCVVSILLSLQSIETNAHVVESGLFSQEELKATKLAKAEHQALLKARRAEKIMDESEDEHDDLAESMMFDNPSTSALDVRPQGSLRITCLTIGSRGDVQPYIALCKGLLNEGHKPKIATHAEFGPWIQQHGIDFAPIEGDPAVLMQLCVDNGMFTLSFMREATLRFRSWIEGLMDSAWKACQDSDIIIESPSAMVGIHISEALQVPYFRAFGMPWTRTRAFPHAFFVPNNKSGGTYNYMTYTLFDTLFWKSTSGQINAWRKRQLGLRPTSLSRLAINKVPFLYNFSKHVVRQPLDWSEWVRITGYWFLDEEQGWDPPEELINFIKKAKDDGKKIVYIGFGSITVENPAALTHTVVRAVVDNDLRCVLSKGWSERLAKAPQLVTAEPDFPPEVLQIKYSVPHSWLFPQMDAIAHHGGAGTTGASLRAGKPTIIKPFFGDQYFFGSRVEDLGVGIYIRILNEKKLGRALYYATHDERMRKKAQYIGEQIRSEDGVATAIRAIYQDLDYARSLVQKKSSKSDAFGKDGHFDFEHEMDEEQWTIVGDEVVPDLKQMPKSMHQDQEEEGLVGEVKN

SEQ ID NO: 7507 - protein, 1464 aa, Alternaria tenuissima
MATSQDRGRDRTSRRLSRKRRNSAREARGMSLDVPERFRDGDDAQEDVTAPKRNNTMSMNQSLFSMIARAGQQSQTDLGTMAEVDSGDSDDGGGKRKTYRNLDGAARLSRLSSANDFQSAEQDADDKMDKGKHRRTLSENKYLRNLPKLKLSSRKEGQAQGRTSNRSDQNQMSSSQFLPPKPSPDDLASPPSSSAMPTKTKTKDKDKKDIGAGEDMAVDKAQASGRKSRHGSSAGLAKSKTPVTLAQRIQQIFEFEEVEEVISEYACWLLQSILLQGYMYVTQKHICFYAYIPKKHHDVSKTGYLSKRGRSKFNRYWFVLKGDVLGYYTTPAELYYPRNRINLQYAISAEVIDPSANTKKGEEETSFAITTDERRYLFKADSAASAKEWTRAIQKVIFRTHNEGGSVKICLPIGNVIEIEESKMLDLAQTVRVRVVDNDETFAIDEYFFSFFNKGQDALNVLRIMINDNEHHQALQQQGGDGEASTPVATPTISTETPHIHENVRATLSPLPAPHAGRTSISDVSARSSNDANRKSWDVRRSMDAGRGFRRTSQEVRRPSHEVRRSFSNRGRQGDRTPGIVGGGGSGEGGSHSRQSPGAADSESAFDPGTESSVAIQSMDESGASASQILDRSDVFRGPVNTPLHKLDTHTRHSQDTARSTQPKSANRSKRPQTPTGAPEFEDDTDNSAQPRLSGSSSALQDLASYPLQKASGLAGFLRTRSKKISNLLTGGESMGYYEKVSGMLAGGRKHYNTAEGLETGDQIHGFEDDEDAAKAAENFRDHFAFPETEVLQSSFFASLQRLVPNYGKIYISGRYFCFRSLMPISKTKIILPMRDIENVNKEKGFRLGYHGLTVAIKGHEELFFEFSKAEYRDECAIMVLRVLENTKYLQEEDSSSSGVDSDDEAAKAEHDLLQQAREHTDTDKPANMSDIVRAADHDRIPLIFDDPLASFVDFKPSEPLTIVCLTIGSRGDVQPYIALCKELLKEGHKPRIATHAEFEPWVRKHGIDFAVVDGNPAELMRICVEHGMFTYGFMKEANAKFRGWLDDVCSSSWRACQGADVLIESPSTMAGIHIAEALEIPYFRAFTMPWTQTRAYPHAFTVTEKKMGGTYNNYTYTVFDKVFWTAIANQVNKWRRRELGLQATNQHKMQANLRPFLYNFSPHVVPPPLDWPDWVRVTGYWFLDESEMYEPPKELMAFIEKARRDGKKLVYVGFGSIVIDDPAALTKTVVDSVLKADVRCVLSKGWSDRLMDPTTKDASKPEIPLPEEIFQIQSAPHDWLFRQMDAAVHHGGSGTTGASLRAGIPTIIKPFFGDQFFFAQRVEDMGVGVWLKKVNTSVFSRALWEVTNSQRMIVKAKVLGQRIRKDNGTQTAIQTIYRELDRAKTLIKKQAKQPGDEGDATDEEIEADWTLVEEGEEMDAVAKHMAEQAAMGGIQQDASRTGGGSLVLGSMVLKGGGGMRRTS

SEQ ID NO: 7508 - protein, 994 aa, Rhodotorula graminis
MDVFGLDEPEEVVAEYPCWLFRAILLQGFLYVTAGHLCFYAYLAQKEGTTVRSGSLSVRSSRTRRYGKHWFVLKDSVFSWFPSSTDPYFPDGHIDLHYAISVEPSQFHKHHFKVATADKKWHFSADSEASRDEWVKTLKKGVFRCQNEGESVKIAIPLETIVDVEKSSSLEFAETIRVRVYDADEFRRTFGLSEKEILLDRFPAYLFRGLPIFGHVYISSAHFCFRSAGLLTAKTKMILPLSDIIGASKHRSYRIGYSGLMVIIKGHEEVFFELNNSDRRDACLANLDEQRELVKKQKRDQSGDDKKDDESEEHQQLRDLLDLSEARSAGQSPLDLPHPRSEAVQGQPPIMFSSTTSDFITFKPDEPLRVTCLTIGSRGDVQPYIALCKGLMAQGHKCKIASHGEYRKWVEGHGIEFSAVGGDPAELMQLMISHDFFTISFMKEAVGRFRGWLDDLLASAWKACQDTDLLIESPSAIAGFHVAEALRIPYYRAFTMPWSRTRAYPHAFAVPEVHMGGGYNYMTYTMFDQVFWRATSGQVNRWRRDTLKLKPTSLEAMQQHKIPFLYNFSPVVIPPPLDWRENIHVTGYWWLDNPDDSDQSKWEPPEELTKWLDEAKDNDKKVVFIGFGSIIIPDPLEMTRVVVEAAEKAGVYAIVAKGWSDRQKGDDDDGEPDEEKEEKREQNEKRHQELMDKPFIFSVKSIPHDWLFPRISAAVHHGGAGTTGASLRAGLPTIIKPFFGDQHFYADRVSTLGIGSHIRNFTVENLTEALKTAVSDDKQIERARLAGEEIRKEDGVATAIECIYRDLEYARSLVPPRSTALVEGEIAEVEVDDDSSDDDSDSGSSSSSSDEKDEKDEKVDDEKARLKERDATEANPGRPAISAPPTEKVQGVQDPSRSAQDPASPSQRDESRATSSDEGWDVMSRGSAADTTVSASWEDGGDASRASSKARSTRSGPEGGVEGAGGEEDDGGAGLTARMLGFLGKPVKAVKKDA

SEQ ID NO: 7509 - protein, 833 aa, Aspergillus kawachii
MASSSDPGVFESPGDPVIVPPTPIAADRKSGIKITKPQAANDNDLSLGSPPAYLESSWKVKLNILIQVVGSRGDVQPFIALGNELQRYGHRVRLATHDVFEDFVRGSGLEFYPIGGDPEELMAYMVKNPGLIPSMRSLQAGEIGRKRAMIRKMLDGCWRSCIEPDMATQLPFVADAIIANPPSFAHIHCAQALSIPVHLMFTMPWTSTKAFPHPLANVTGSGDEDQGFRNFVSYAVVNWLTWQGVGDVINHWRKELGLDEVAMFEGPRLAEILKIPFTYCWSPALIPKPSDWPSHIAFPSPSEDVCGFFFRDPPRYDPPADLLAFLAAGPPPIYIGFGSIVLEDPESITAIILNAVRTTGVRAIVSKGWSNLGGMHDDNIYFIGDCPHEWLFDRVAAVVHHGGAGTTACGLRKSKPTIVVPFFGDQPFWGDMVAAAGAGPTPIPHKELTVDRLAEGIRYCLSEQARMSAVAIAAKMQSEAGVKAAVASFHRNLPLECLQCDLDPGLPAVWSLRQKRRKFKLSKIAAEVLIADGSIDAKSLAMHAIRPIFIENRRWDPVTGGASAVVGTATDVADSILGAFYKPALEYHKFKEEREDQLSSSRSNLSVENLSDSLSVHTVSTDHEKEPRGMSISSSNNSTVSADSDAQKRSGTGKRKLFGRMAASSAKSLGSVGPAMIKGTTVDFPLALAEGLRNVPRLYGEEPRDHGPVTDIKSGFAVAGKGFAWGMAEAVSDIVVKPYQGLQKEGAKGAIKGVGKGVTNMAAKSGSAMFGLMAYSTAGIAQSLRSSGQSRVRKLIAQQRHSEGTWLLESGQYTATENIVATFRQKLRSTKDA

SEQ ID NO: 7510 - protein, 1450 aa, Cyphellophora europaea
MSTLDSAPRKSGSRKLQKRNRPNRMPSSRMPARLKLGDDAQDDVTAPDRGSQAASQYMNMNQSIFSMIAAAGSKTDFNTRFDDSSDSEEDIQEEDEVAYEQHETQDSTTAAPSKSQDAGSESTALKKKKRLSDNKLMQSLPKLSLRPHSRRKPSSHNSPSPSSDGTTKSSKSNPREAPVMSRLLTAEAALEAADEEEMLASGQKSTRARGDSSPATLLASRLMDIFGFEKPETVVAEYQAWLLQSVLLQGYLYITKYHICFYAYLPKKSNSVAKNGYLSKRGKSNLKYNRYWFILKGDVLSYYADPSAQYFPQGNIDLRYGISAALSADKDKQKDCKDFSITTDHRTYDFRADTAESAKEWVKSLQRTIFRSHNDGDSVKISLPIQNVIDVEESPVVQLAHTIKVRVIENDASYAIDDYYFSFFNNGPDVLNVLAGLVPDMSIPDGQDPGSHLDERRARSPGARKSLDMLGAPRDRSVTPLRESVRATLMPFSVDDNGKMSPRMSGEFSRPSKSPGRLSLDAGSLEYGRASFDRGRRSPSTGRLDVGTDRRSGRSPLARVHDSPESHNQIADNATDSSAPPLSPKAEAQMSASQILTRSDVFHQPRVQRMDTVPSVSTDPTRRSSEIETTQSSSPKQEATPPIPIRTRPAPKERVMSQDSDYFEARNEHSRERTSSPTIQDLMKVGSYPLQRAGVFAGYLKSKSNRMSKLLATESMSYLEKVSGMWAGNRKHYGANETILSDDRDVDPEDEEANVGFGDRFRMHFALPPTEKLQATYFCFLHRVLPLYGKIYISNRKFCFRSMLPGTKTKLILPLKDIENVDKEIGFRFGYHGLVLVIRGYEELFFEFAGAENRDDCAVTLLQSLEAGKYMEDDSTILNPDEDSAALARDEHRLLQEARKTSTQIEKEIDAPDTDETVYKHDEPPPILFDDPRVSIINFKPVSSLRVTCLTIGSRGDVQPYIALCKGLLADGHQVRIATHREFQSWIEGHGIEFKPVEGDPAELMRICIENGMFTYSFLREATFKFRGWIDDLLVSAWEACKGSDLLIESPSAMAGIHVAEALGIPYYRAFTMPWTRTRAYPHAFAVPGHKSGGAYNYYSYVMFDNVFWKAIAGQVNRWRKKELGLRSTSLDKMQPNKVPFLYNFSPSVVPPPLDYSDWVQVTGYWFLDEASDWTPPSDLVAFIEKARADNKKLVYIGFGSIVVSDPAGLTRTVCDSVLKADVRCILAKGWSDRLGDPSAIKTELPLPPEIFQIKAAPHDWLFRQMDAAVHHGGAGTTGASLRAGIPTICKPFFGDQFFFGSRVEDLGVGICLKKVNVSLLSRALWEAVNSERMIVKARAVGERIRKEDGVQTAIRAIYRDLDYAKSLVKTRADLQGRPVPQDDEEEGEIEETWTFIGDESDVDLQRKMQELDVGRTGRGPRVSMDQLRSVQGVEPVRSEGRKSGVFSRS

SEQ ID NO: 7511 - protein, 1218 aa, Lachancea fermentati
MSNSFSDETETESSVAPSKELTNSSSKSKWRNSKWPVGKMYHSVSNLANLRRESTSNETIKSGSTTEETTSTKEFEDDLARPCGMAKSIVGLLTTASVYAGMGEIEQAEDICEDENDNTDSDSDSTIEETSLHSDAFTQASRKDTLFEISIEPNEDARSLITSSSKYKPSKLFKKLSSRFDLDEEKDLFITQYSCWLLKDVLIQGHIFLTTQHLLFFAFLPKSNGTPKLSGNLTTFNSGSLGARSARYWAVLKDHTLSFYSSPKELYFPILTIDLRYTNKIEVVKEDGEVTADFKIYTDNKTFKFRADSEYASRSWCSALKKQVFASQHSKNDFMSIKIPLANIIDIDEQLVVAETVTLRVRVLESSESYAIDDYFFMFFNKSGITLKKTINVQLVNLELNGSEVLMAKKPFPDGDSIKEVSQNSSPQESEHRGRSLSTSRRLFKRVLSPVSLRNRHALSLSSSLSPRPPRKVKERLRSMTDSLMSKSPGQGDVEEELNIDYTSQNEQFNDEENLSDSEAFSEENHGRSDSPEGGEKPHYSRLARWTPRPIKNMGSMWSAHPVHYQFDKEQLFPGDDEYLTSSLDQQRANQRFKSHFSLDDDESLRAAYYTYLNKNIPIYGKLYLGKSVVCFRSLIPRSKTRMILPIKDLENCYKERGFRFGYFGLVLVIHGHEELFFEFSLRSSRDDAEFVLLKLLDIAKPALKSTEVEIDRTSKKTDNTGIIKNDNLTEAAKVKLFEDKINAEGFDVPFMIEESPYYKTSITPKKSYRFGLLTIGSRGDVQPYIALGKGLVKEGHTVTIITHEEFKDWIKSHGLMFKKIAGNPAELMSLMVQHGSMNVGLLREASTHFRGWIQQLLETSWQACQNLDILIESPSAMAGIHIAEALGIPYVRAFTMPWTRTRAYPHAFIVPDQKRGGNYNYLTHVLFENIFWKGVSGQVNKWRVETLGLEKTNLDLLQQNKVPFLYNISPTIFPPSVDFSEWVKVTGYWFLDEKSTYAPPAALIEFITKARRLNKKLVYIGFGSIVVNDPKEMTKAVVDAVVNADVFCILNKGWSERLGGDDAKSIEIELPECVYNSGSVPHDWLFPQIDAAVHHGGSGTTGATLRAGLPTIIKPFFGDQFFYAGRVEDIGAGISLKKLNSETLSRALKEITTNSRIINKAHQIKEAIAKENGIEVAISCIYSELEYARSLILAKRRKGKKVDSDDSNEEDSSWFLV

SEQ ID NO: 7512 - protein, 1583 aa, Cryptococcus gattii
MSPPTSPTSHSLQPPFPPSATAPNPNPPSQHQQAVESLVNAAAQHVGPTCPPTSDESPQMADQATNSPDDSLIWNRQVPEQEQTETAIIPGTPLDEMEPAKDAQTVQFSSSSPASTHEYQGETTARLNEPLTSSRAPSTASSQIDDWRRPDFGASRDIGSVRMGGASALVSALNALPWEEDDESDDGEDDDEFRDPAGGTSSAVYERKKRPQLPSTSHGSHPTHPIHFPFRQNAIARRARPPGTTELDYQYATSETSSRGMSETGSESSSEGEVPLPKGFVSPPNLIAPSAEDEATGPPDPKLISDRMEKEQQIADEEEQAEILRSSKEEEMRLGKEFVPGKSHGSAELNVDAALSEGGSEGEYVIEEQMQTNEAEKNLTRKDKLAERLMEVFGLEEREEVLEEMKCWLLRSIMLKGYMYLTKRHICFFANMPNENNLLVKSGPLYKKASRSKLNTKFWVVLKNDVLSWYENTTDPYFPKGNISLQYCHSCEAASGTRFKVRTSERNYTFTADTESSRDEWVKSIQKVMFRTQHEGESIKLIIPLEAVVDVDKSPTLEFTETIEVKCIDAEDQMSIDSYFFASFPNNDHAFSAIQKLVRERPSPPEVPRVSSATTIHVNQEPLDTSHATITRSGTNSSAEKLGTASHLPFRKFASVLKPLISKSSDGEPREEHSEDNHQDDHEASHLPHVEVTSNRQRSEEESDNDDFDGYPPRQVGPPPPSMNDDARNWRPSWIRKPASKLFGSSPSGSFVSSPGRSPMDSSTTVTETGPSLRTRTGRTKQSSVTEVLEPPIQPEEEVSEDEIPSKPSVVDSNSAEAARKRAARLSWTSETSSGSQMVKSKSDFSMLGSESGHSESAETLRKFRTFFALSDKEDLIDHFPGYLYRVLPVSGRFFISTNYFCFRSSQLLYKTKESFKLMIIPIRDLYGVKAQKAFRFGHSGLTVVIKGREEIFIEFRSASRRKACITLLEERMEAVRLSGENNTIDSRKVEVRIMEDLDESTPFEPKSPWPVSSSPLFGSTTSTSFLEFKPEPMKITCLTIGSRGDVQPYIALCKGLQAEGHTTKIATHGEYKEWVEGHGIAFESVGGDPAKLMQMCVDNGMFTVSFLKEGLQKFRGWLDDLLNSSWDACQGSDLLIESPSAMSGIHIAEALRIPYYRAFTMPWTRTRAYPHAFAVPEHGRGGPYNYMTYTMFDQVFWRAISGQVNRWRRNVLGLDATTFDKMEQHKVPFLYNFSPTVVPPPLDWTEWIHVTGYWFLDQADQKQGEKSWTPPEGLTGFIDKAHGEKKKVVYIGFGSIVVSDPEEMTRCVVEAVVNSGVYAILSKGWSDRGSKREEPKGDSQGADGVKYPPEIFAIDSIDHGWLFPRIDAACHHGGAGTTGASLRAGIPTIIKPFFGDQAFWAERVESLNVGSAIRRLTSHQLASALTKATTDEKQIFKARVVGEMIRKENGIARAIEAIYRDLEYAKSIIKSPPSTDDKTPEKISSLLHPLITADLGVRRVRSRSRSRSSHGRFSPRRHPVDDDGWSVVTGGSRSRSGSASAVASPDRRSLNIGSALGSHVFKAPLLPNPFGKWRSSEGEDDR

SEQ ID NO: 7513 - protein, 439 aa, Thalassospira profundimaris
MHVMLMTYGTRGDVQPFVALGHGLIQKGHRVTLAAPERFAGFITDHDLEFTPLTDAMIALMDDPQFARASDPKASTFQKLRSLLSIGKKARGLQNTLFDDIFRAIDQAKPDVIVFHPKAFGALPIGRHFGIPVVMAQLIPSFLPTGDYPHVGVPDLGLRGASGRWYNRVTGKLVYRVLNATLRRQVCRWAARRQNGINAKSLDIMKSCQSGTLRIIHAFSNAVISRPKDWPTNATVSGYWFLDGAAQTNPPDPALQNFVESQKNLIYIGFGSMPGNDPTAMAEMIAEAVSQAGVSAIVATGWGGMDNINWPANILAVREVPHDWLFPKVDIVIHHGGAGTCAAALRAGRPSIIIPFFGDQPFWAKRLHRLGVAPRPIKPAKLDAAMLARQIKTVLETPSYRNNAERLASKIANEDGITNAIAEITRAAEQSDLPKTGSL

SEQ ID NO: 7514 - protein, 1427 aa, Cordyceps militaris
MYPGSTLLQPTAPTSPTDKLAATKPTQHRPGRPIFDRRLLSPPSISYSIIVMASSPPASVSGGLDHGTRHRSTMRRKAPPSLSSSTPDLPEPLQDSDDSADEAHPQVMATPMSVNMNQSIIGLIAAAGSRVDFHTRFDGNSSDEDDTKDSVSSPPNISQTTVLRPIKKHQKSPSKHRLLKSFATLPRLRPKSKHEPSSLSHAGPSTDDPSQSSDTSDTQALTPTETTAPTARRPSVMSRMLQARAEMSSRPSFDMERKSADLRPSEEDDEATPLARRLMEIFDFSEPEQHIVAKSGYLSKSGKRNPKYNRYWFRLKGDVLSYYRDATNLYFPHGQVDLRFGISASVTDTDKDGLHFEVVTNQRTYNFRADSAPSAKEWVKSLQRVIFRSHNDGDSVKISLPIENIIDVEDIQMVEFSDTCKIRVIDNDETYAIDEYFFSFFSFGQEAINVLKVLVEDSAAKKQRGRDKQIAGTSSQTQAGLDKIYTGKVRDTVKATLSPLSPGRSRAASPRGSVEISSRTSRDGFGGIERSSLDHQRPLTSPLNDRSPRRSFSSSRPRSRHSDGGKTPRTRFFTSDSNLQSEKSSIYDPSFSSMTASGAEDPSASQILHGSDAFQRPTIMRSQPTDQEQPSSLSQTQILHPGSDATFHPARHAATTGHLDQLRQEHEQESRDEERPLTPSLQSITKMGTYPLQRAGAFADYLNKTSKRMSSLLATESMGYVEKVSGMWKGGGKHYDEPAGLRADDDDLEEDSDGKVQTSMDRFRAHFALPDTERLQATYFGYILRVLPLYGKIYISDKSFCFRSLLPGTRTKLILPLKDIETVHKEKGFRFGYSGLVLVIRGHEELFFEFRQSDVRDDCAVTMLQDLEAHRFLEGSDSHADDAPEDDEYIAERDALKRARQEEYPEHELELPHDVSSIPNAPTILLEDTDASFLSFKPSTPLKITCLTIGSRGDVQPYIALCKGLLAEGHKPRIATHAEFQGWVESHGIEFAKVEGDPAELMRLCIENGTFTLAFLREANSTFRGWLDELLDSAYTACEGSDLLIESPSAMAGIHIAEKLGIPYFRAFTMPWTRTRAYPHAFIMPEHKMGGAYNYMTYVMFDNIFWKATAQQVNRWRNKTLGLPNTSLEKMQPNKVPFLYNFSPCVVAPPLDFSDWIRITGYWFLDEGDNYTPPKELADFIQKARDDGKKLVYVGFGSIIVNDPAKMTREVIDAVLKADGWSDRISSKEDPNKKRPDEPEMPPEIHVIKSAPHDWLFKQIDAAAHHGGSGTTGASLRAGLPTIIRPFFGDQYFFGSRVEDLGVGVWVKKWGTNSFGRALWEVTRNERMIIKARVLGEQIRKDHGVDMAIQSIYRDMEYATSLIKRKAGKNGQPEPDEDDEETEESWTFVGGDEPDPDMVTKKLSEGLENLAFERDRALRDVAVSSGA

SEQ ID NO: 7515 - protein, 1453 aa, Pochonia chlamydosporia
MDSFPPMSPSSGGGSRLSTGGEDSGGQRRVSRKLQKKRRDDPSATSLDLPEPLKHGDSDDEDSPNDPASQRGRAMSVNMNQSIFGLIAAAGSRVDFNTRFDDGSSDEEDSENLKSSSGSQDLSQTVILPPRDKDARRGHKKRLSSGHRLLKSLSTLPKRKGKKKEVSRLSAPPLDSSDEAQETVDLATSTVALEKEDNRLAPVMSRMLRARAEVASRPSFDLERKSSDLGGSDDSDEASALAKRLMEIFEFEEPEQVIEEYPCWLLQSVLLQGFLYITAKHICFYAYLPKKAHVVAKSGYLSKSGKRNPKYHRYWFRLKGDVLSYYRDSTNLYFPHGQIDLRFGISANVVDTDKDGLHFNVVTSHRTYNFRADSAPSAKEWVKSLQRVIFRSHNEGDSVKISLPIDNIIDVEETQMMEFSETCKIRVIDNDETYAIDEYFFSFFNFGKEAINVLKILVDGASSNNRTPGKVIAEQELQHLQQPEQHSSSQPSRQISPHPAKAPTHQSIHVDKIRTAKLPESVKATLSPMSPHSANPSPRASMECSSRTSLDAIRHMGRRSHEVSSMIREQSPRRSFSGHRRTQSTRRGDEKKGRHIMESSDSNLQSSTEDPSFSNLTISVATEDPSASQILKGSEVFHSPTMRRSDASSQSTDAKEEELHRESESSIPAESMSMKHAATTGHMGQLGYHGQGMGPRSTTPTLQSITKMGSYPLQRAGAFADYLNKTSKRMSSLLATESMGYVEKVSGMWKGGRKHYGEPAGLRPDEDELEEDSDGKIQTSMERFRAHFALPESEKLQATYFGCIIRVLPLYGKIYISDRSFCFRSLLPGTRTKLILPLKDIETAHKEKGFRLGYSGLTIVIRGHEELFFEFSQVDVRDDCTVTLLQSLETNRYLREAGILHQEDHEEEDQAMAERDALKSARQEDFPQHEILPPQQADSQPNAPTILMDETDGSFLNFKPPQPMKITCLTIGSRGDVQPYIALCKGLLAEGHQPRIATHAEFQGWIESHGIEFAKVEGDPGELMRLCIENGTFTISFLREANSAFRGWLDELLDSAYQACLGSELLIESPSAMAGIHIAEKLGIPYFRAFTMPWTRTRAYPHAFIMPEHKMGGAYNYMTYVMFDNIFWKATAQQVNRWRNKTLGLPNTSLEKMQPNKVPFLYNFSPSVVAPPLDFSDWIRVTGYWFLDEGGEYEPPKELSDFIKRAKDDGKKLVYVGFGSIIVNDPAQMTQEVIDAVLKADVRCILSKGWSDRISPKDDPAKPRPDEPEMPPEIFVIKSAPHDWLFRQIDAAAHHGGSGTTGASLRAGIPTIIRPFFGDQFFFASRVEDLGVGVGLRRWGANSFGRALWQVTRNERMIVKARVLGEQIRKDKGVDTAIQNIYRDLEYAKSLIKRKAKQNGQPDAEEDEDTEESWTFVGTDEPDPDMVTKKLSEGLGGLSPQRSLGSQAIKASS

SEQ ID NO: 7516 - protein, 850 aa, Rhizoctonia solani
MQPNQRDSSYAPSRGYQRYNSYHDLPVPSSAPGSVYNSPNTPSRSFESLAQATIQPPPPPLYTRYDYGSQAGPSAPRPSMHSYSSSSSQISTLEKDHPTLPGYTQLDTKTVVSEDGRLNISFGNRMSKALPESYGAPVHEEGIDETGFRSAPRMNINIMIVGSRGDVQPYLALGKQLQQYGHNVRLSTHETFRKMVKDAGLRFYNIGGDPHELMSYMVRNPGLIPGIESLKNGDIGKKQKMVGEILEGCFASCFAPDYGSGEDTGFAADAIISNPPTFAHIHCAEALGIPLLLSFTMPWCPTASSPHPLVNIKQSGSTEPRMANYYSYGLVDLMTWQGLGRTINKFRMKRLGLEYLSTTSAVGMLERCAVPWTYCLSPALVPKPSDWMSHIDVVGFYFLDLASDYAPPANLVEFLKSGEPPVYIGFGSIVLQNPQEMTKAILAGIAQAGVRAIISPGWGGLDEDLIRSAGPHVFALGNVPHDWLFQHVSAVCHHGGAGTTAIGLRCGKPTIIVPFFGDQPWWAVQIARRGAGPPPLDSKSLTAAGFAAALRMALSPATLESAQVVGAMIRQENGAQNGVDSFHRHMPLLNMRCDLDPTRVAVWYSPAHNMRMSAFAAQVLSESGYIDINQLKLHRSREYVTQIDAFDPVSGTLSPAMKLLGDFGRGVSKLPTRPDKGMAQIVVAGTFGATSTLKGTADGFANLPKLYGGQVRERKKVNGVGSGLVEGTKSLIFGAYDGVNDLFREPVRGYKENGILGAAAGVGKGTLSATTKPLAGVLQFISQPLEGTAKDVRSLFRKEVGKERIAARYAEGGLLARRASEKEKQAVIQAFMERGCTVRVAGKGKAKLAW

SEQ ID NO: 7517 - protein, 1229 aa, Coprinellus micaceus
MPSDDSPFISPPSPPLRPSLSPFRGDGSMRAGTQTLIQALQALPWMASDDDEGPGDVQSEPESEEERPGFNRLSSSIHAIYRPLARSKRMDTSLFVKDNRSASPVAEEEDASEDPSVSEDEIEPDFDNTPRPSHASTGHVRQHSQDTSLSLRPNSERQGSASTMHSHHRRERLADKLREIFELEGIHEKCLVGCCDRSGYMYLTDNYLCFFAHMPTREDQVLKSGSLSKRAQRTKRWVKHWFVLKNDALSWYQSSSDPYFPHGIVDLRYAVTCEPYGDKEFRLRTHQKTVHLSADSVPSRDEWVKAIKKVIFKAQNLGDTVRIAIPYSVILDVERSSAMDFSETIEVKVVDKEDQFSVDSYFFAYFHDLVAALEQIREAVRAHRSLPDQQIEHPLLDTTSTRTATGATLERTTGTLSTDAVAPKPSTSGFRLASLLRPFSDTISLHRTVSVPVDPHVMNQDDYTLVSQRGGSSFVPFTTSPKPFEQSTPPTSTKEQFEFKSKPSTNSLPTPTTAEHTYPPSTSTASSIDPNLLSLTRESTSSWSVGVPSWLKNKRMFGATTSYPPSTATESSTEVVKEVYSSPASASVSQSRFGTGDLAFSILETPNMPVDVETTEKFRAYFAYDERETLLGYFPGYIYRLLPVYGRLYVSTNYFCFKSTGALASRTRMTLPIKDILSLEKSKATRFGHHGLVIMVKGHEELFFEFGAPDKRDAFVRLLERQMEDVRLRLALQNPELPSPGTKAALTLESLEPSKGDETDDEDPAPPPDNAADDLPAVMFTSASSTFLTFKPHKPLHFTFLTIGSRGDVQPYIALSKGLMADGHKCRIATHGEFKEWIEAQGIEFGFVGGDPAELMRICVENGMFTVSFLKETLQKFRGWLDDLLKTSWEACQGTDVLVESPSAMGGYHIAEALGIPYFRAFTMTWTRTRAYPHAFAVPERKMGGGYNYMSYVMFDQVFWRAIAGQINRWRRDFLHLGPTSLDRMEPHKIPFLYNFSPTVVPPPLDWPEWIRVTGYWFLDDADVSAKKWTPPDALVEFIDNAHAQGKKVVYIGFGSIVVSDPKTMTRCVIEAVVQSGVYAILSKGWSDRLHVKVNDAAEPEEPLPPQIYPISSVPHDWLFKRIDAACHHGGAGTTGASLRAGIPTIIRPFFGDQFFWADRVEALGVGSGVRKLTVATLKDALLKATTDQKTVDRARLVGEQIRAVHLLFFRVYFVILTTPCRRMVSQLP

SEQ ID NO: 7518 - protein, 810 aa, Aspergillus fumigatus
MGRPETRAEPSENDGPPPYSALDEGLVGESADVRADGRVDVDLNSRIARTLAQIIELQQEDIHNPPPDYQQELQQQRDQDQDHQLEPIECSIHLNIVIQIVGSRGDVQPFIALGTELQKHGHRVRLATHDVFADFVRSSGLEFYPIGGDPAELMAFMVKNPGLLPQMDSLRGGEIQKKRAMVATMLDGCWRSCIDDDPLTKAPFVADAIIANPPSFAHVHCAQALRVPVHLMFTMPWSSTTAFPHPLANLRPSDMSPRTAHWVSYGVVEWLTWQGLGDVINRWRATIDLEPVPMAEAPSLAETLKIPFTYCWSPALVPKPRDWAEHIDVCGFFFRQPPSYQPPPDLEQFLASGPPPVYIGFGSIVVDSPQRLSNTVLQAVAASGVRAIVSRGWSKLAGDGNPNIYFIGDCPHEWLFQHVSAVVHHGGAGTTACGLANGKPTVVVPFFGDQQFWGNMIARAGAGPSPIPHATLSVRNLAEAIRFCLKPQTVAAAREIAAKMQFESGVTAAVQSFHRHLPLEQMRCQVFPDQVSVWKYARHKREIRLSRKAVQILIDHLKIDPKNLRCYDIKPIIIENRRWDPLTGVTSAAVGTGTDLLKSTTNMFYKPYKELARNKTDVAPDGAERHPVVTVGAMAGQFAKSFGQFMGSYAKGVIVDIPHAAAEGFRQVPRLYGEQPKVYGAVQDWKSGATVGGKNFVDGMMEGFSGLVTQPIKGGKEEGALGVVKGLAKGTAGLVTKVPSAGLGLVAYPFQGIVKSIESSVRSKTRKAIITARLRDGYELSRREEVSQEERRFVLQKFQSLLCGPTATPT

SEQ ID NO: 7519 - protein, 424 aa, Rhodopirellula islandica
MRILVLTVGTRGDVQPYVALAGGLKEAGHVVQICTCQVFEGFIRSHGIDYAPLNNDLRDFMESDEGRSAMETTTNLFQMVRAGIRLMPKLTDMMHRQVNEMWTAAEAFEPDLILFHKKAIGAEDFAERLGCRCALAFYLPLYVPTGESPAFGFPRLPLGRWYNRATYRLIEFISRRSGARFVGKWRRSQGMTAKRPAYFRHAGGSPVAALHAYSPSVIPRPCDWPDHATVTGYWFLDASTEFIPDPTLVKFLQQGPPPIYVGFGSIFGRDPRATAERVIEAVRLSGQRALLAAGWGGMDLNKFDLPETMLSIDAVPHDWLFPQVSAVVHHGGCGTTAAGLRAGRRTIICPFFGDQPFWGRVVQDLGVGPQPIPQRKLTPKRLANAISQTMEDREMEVRADQLGKPIRSESGVQNAVRFIDELSV

SEQ ID NO: 7520 - protein, 1408 aa, Mixia osmundae
MSEAQQDTTSTSVSPTSRPPRHVPAREDSVQETEPAEGASAAQRASITRSISSQGGSGSILGMISAFGHQQQDMGEDADADTSDDEARPASTRPARPRRQSTIRPTPSSSLRASDIGSDDAEESAVVAQASRILPMRHPGSKQQDWAAHNSPRARVQESGDDAHTTTDDEAVKPGMRELLGERRQRSSSAAGPSAPTTSPSIPSESPRSPADQALAVSLDEASEGINDQMRVSPRSEEDRKTLLAEKVKEVFGLPTVEPLTHELSCWLYREILIQGYMYLTASHACFYAHMPRRYGQVLRSGSLTKRSSKTRRYSRHWFILRNSVFSWYSSSTDPYFPEDAIDLEYCTSVESSLNHSTHFKVAIRDRRYHFAADSRANRDEWVKILRKAVFRTQHKGESVKIIIPASAIDQVTRQKPLDFAETIQIEVREQISKEHATLQFAYFADLDLAMEALRFLSESAPATQSQLIDTTTTVHPTEPTGMTDTEDDSDFGESRGNSRNISKKSSLSALAGHIKPGADHSSDMTGGRSSADLSDHDSLSRIRSADSQTTLSEKTRRTRKAQKLPQLAKDDSTHTYPPSSPHSRANPLSPDSSDSWSLTSVLKRPAKTLSGTFGSKRNQSASSEAFSPDSLSPSHSFSQKQDDQSYSFVLDKDAIVDDERAHRSSVEAEVHADFRKFFKVAGERVIESHSGWLARALPVYGRVFVSTHFVCFRADLISSTKMVLPLTDVIAVQKHRAYRPGYSSLVIVVKGHEEIFFEFGSSSTRDRMLRSIEGRAEYLQDLEEHPRTNEDILPSTREAEMLKDLEPRAGKNEPLPPPETSAESVPPLMFRSTSSTFLNFRPHKSLHFTCLTIGSRGDVQPYIALCKGLIAEGHTCRIASHGEYRKWVESFGIEFGEIGGDPAELMKLCVDHGMFTVSFIREGLVKFKGWLDDLLKTSYEACKGTDVLIESPSAMAGLHIAECLQIPYFRAFTMPWTRTRAYPHAFAVPDTHMGGSYNWMTYTLFDSVFWKAISGQVNSWRKHTLGLRSTSADRMRQQCVPFLYNFSPSIVPVPLDWPEYIHITGYWYLDNADDSGGVDEWTPPDDLVAFLDRAKQEHKKVVYIGFGSIVVSDPDALTKTIVEAVNKSDVYAVLSKGWSDRGSKKSATGQDDKASGDKKDKAMMSNTIFNIKSCPHDWLFARVNAACHHGGAGTCGASFRAGIPTIIRPFFGDQHFWADRVDALGIGTALKKLTVDSLSDALIKATIDEKQIARARMVGQNIRKENGVANAIEAIYRDLEYAKDLIASIKTKRVEPEILDTTTDEEHDSLPRTTTEKVEAIVSGNASDPSDESSWDLVHDQQDQDEPDTGGQASKGGIATLTGPMRKLLQRANDDSSDKPGALSKVGSGLFDALPFGRNDAVVKATD

SEQ ID NO: 7521 - protein, 1470 aa, Metarhizium album
MDSFAPLSPNGGDASPQSAGAGAGAGAGAGAGAGAGAGAAHDGVQRRVIRKLCKKNRDDPSATLLDLPEPLKHCDSDDEDSPNDPASQRGRAMSVNMNQSIFGLIAAAGSRVDFNTRFDDGSSDDEDSEQSKSSSGSQPLSQTIILPPRDKDARRGHHKRLSSGHRLLKSLSTLPKRKSKRREASRLSAPLMDSSDEARESTELSASAIAPHQEDSRLAPVMSRMLQARAEVASRPSFDMERRSSDLARSRDGDESSALAKRLMEIFEFDEPEQVIEEYPCWLLQSVLLQGFLYITSKHICFYAYLPKKAHVVAKSGYLTKSGKRNPKYHRYWFRLKGDVLSYYRDSTNLYFPHGQIDLRFGISASTVDKDKDSLQFNVVTSHRTYNFKADSAPSAKEWVKSLQRVIFRSHNEGDSVKISLPIDNVIDIEETQMMEFSETCKIRVVDNDETYAIDEYFFSFFNLGKEAINVLKILVDDASSTQRTPGKLIAEQELQKQDQPEQNPNSQPSPSISQQPAKLTSRQTIVVDKIRTTKLPEAVKATLSPMSPPANSSPQVSMECSSRTSLDAVRCKGRRSQEVSNMISEQSTRRSFSGHRRAQNARQSEDKKGRHVMEYSDSNLQSSTEDPSFSNLVMSLPTEDPSASQILKGSEVFHSPTMRRSDASSQSTDPREEELSKNSEKFLSDASAPMKHAATTGHVSQFGYHGQAEQAGSTTPTLQSITKIGSYPLQRAGAFADYLNKTSKRMSSLLATESMGYVEKVSGMWKGGRKHYGEPAELRTDEDDIEEDSEGKTQTSMDRFRAHFALPESEKLQATYFGCIIRVLPLYGKIYISDRSFCFRSLLPGTRTKLILPLRDIETAHKEKGFRIGYSGLTVVIRGHEEVFFEFSQPDVRDDCTVTLLQSLETNRYLREAGLLNQEEHEEQHQAMAERDALKSARQEDFPQHEILPPQQADSQPNAPTILMDETDGSFLNFKPPQPMRITCLTIGSRGDVQPYIALCKGLLTEGHQPRIATHAEFQDWIESHGIEFAKVEGDPGELMRLCIENGTFTISFLREANSAFRGWLDELLDSAYQACLGSELLIESPSAMAGIHIAEKLGIPYFRAFTMPWTRTRAYPHAFIMPEHKMGGAYNYMTYVMFDNIFWKATAQQINRWRNKTLGLPNTSLEKMQPNKVPFLYNFSPSVVAPPLDFSDWIRVTGYWFLDEGGEYKPPRELSDFIQKARDDGKKLVYVGFGSIIVNDPVKMTQEVIDAVLKADVRCILSKGWSDRISSKDDPAKPRPDEPEMPAEIFVIKSAPHDWLFRQIDAAAHHGGSGTTGASLRAGIPTIIRPFFGDQFFFATRVEDLGVGIGLRRWGANSFGRALWQATRNERMITKARVLGEQIRKDKGVDTAIQNIYRDLEYAKSLIKRKVGHNEQPDADDDEDTEESWTFVGADEPDPDMVTKKLSEGLGFFGKQRSLGSQAIKASS

SEQ ID NO: 7522 - protein, 1396 aa, Nannochloropsis salina
MMSSCSPSPPSPEEDELAPPATEESRTALPLTMCPPAPTIYRNIGVEESPSRRDRSGSTASSKGEGLGITEGAQPRADAPLTPTPQRPELPLSSVAPASPVGSAAGGTGSADKEDAPSLTRTAAGCQDPGLTPVGPDEGDGGVLSDGNACRPSRGQSAEGQDDGLETYLALSEEGSSGSREDEEDDFVRVEPEMHRGHVEVRVLKEGWLQKQCLRVVDGRPSMWRHFAFWKQRYFVLGSDGVLRYYKDAERQHFRRAIPLAGMEVTAHFYAPADPGEGGETAALCAWEGEGTSLSVLAAAVGSAEGEKGGKCLIIRPKQVPFPSRRRASSTGGQTEGASVEEEMKLLATSKAEMQEWLGALRGELEATERQGQTLFNTAWSLLRSYIDRPQGEARTPGGGEEVGLGARGIREADVGPPPMDLQHRSSSLSPSSGLPMSGSESAAPMADVSFVPPSVPIPRMKVVMMVVGTRGDVQPFVTLGLALQAQGHRVRLATHAMYRPLVVEEAGLEFYPLGGDPLKLSAYMVKTAGRVFPFKLPDHQEMTKDVPEQRAMLSEIILSTWPACTAPDPEDPLKRGFRADAIISNPPVYGHVHCAEALNVPLHIMFPQPWSPTKAFPHPLSGLPYHGHWCKENYYSYLVVDKFLWLGIQDIVNELRVARLGLPPLRLGEHGGDLLNRYRVPFAKMWSPCLVPKPKDWGPHIDVVGHFLGPQTSGTPPGAEALQAWLEPTAPGLPAPPAPIFVGFGSMVIPDARSLVAMILEAAHLTDTRVVLQSSWTELPLPPVAVALPSATPSTPTVFSIGNCPHDWLLKRCCAVIHHGGAGTVAAGLRAGKPTMVCPFFGDQFFWGQMVFQARVGLPPVPVVELTAEKLATAFKDLRSPSLVSAAERMAERLGREDGAKEGLKAFYRHLPVEDMVCDVSLFTDTPRLARAFCTTCGLKLSSEAHAALHCAGPRTESGGDGPAHADHDVRAYSAMDWASLSGPRDATEGLVQGLSSLTHEFLGSMAGVVTEPVAGAHKTGVRGAAQGLASGLVNLVRRPIRGGIIFVDKVTTGVSNQLQLQQSSHGVGMASSLSPSFSSLGSQGEGKGQDNEAGVWQDNLSISCELVKELRAAHAQALQCKALFMRLSKGDPRCVPKEGVLNLLEEVQTEVRECDMSDESGRYSVFGMCGAQEEAEERKVLSRALLERIDAVGAGQISFQQFCVFFKALRRGALMQPSTREPGTVSIASEATAERRHAPAVALTETPEPTKMEGVPGESKPSSVAVAMVGGPTAEGENCKKSKLLDSLIFDSIFLEERSSAPLPQPSSNCLRLSLDCDQVELGENCEERSGAERKEHDQVPDDDGGSSASSASSGIMEDVEIQVDVLRRDNESSKSGDADYLGEEEDKGPKACP

SEQ ID NO: 7523 - protein, 1411 aa, Trichoderma virens
MATTPTPRRISLDGQDHVELPQTSTTHDDPTPTAELPEPLQGSDDETSENADLHKPSHMAVNMNQSIFGLIAAAGSRVDFNTRFDDGSSDEDEGGSLKPPSARHRDLSQTAIFGSLPPRDKRLGRGKQVPGHRMLKSFASLPKRKSRSGTGSSRLWEPTQEVDEQSEPSEPSSPKIPSQQPDEDVRIAPVMSRMLEAKAEMASRSSFDIERDSSGPDRTDEGEAEDEAEDDEDEDGEDATALAKKLMEIFKFDEPERVIEEYPCWLLHSVLLQGYLYITSKHICFYAYLPKKTHAVTKSGYLSKSGKRNPKYNRYWFRLKGDVLSYYQDATNLYFPHGHIDLSFGISASITDEDKEGVHFSVVTSHRTYNFRAESAPSAKEWVKSLQRVIFRSHNDGDSVKISLPIENIIDVEDTQMMDFSDTCKIRVIDSDETFAIDEHFFSFFTVGKEAINVIKLLVENASAEGPTAGKVIAAQEGESSDQSSSPHISGGAFRNLARVDSALTTKFLSTAQEVVSSASPKSTSPSPHPSADEEGVLSLKSSRGRGSSDDRRLEGDRHAEERTSSRIMESSESNMYSSIEEPSFASLTQSAFEDPSASQILRGSDVFQSPTMRHSQTSSRDYNEFKDKAPESKQGQQGSAAASQSEGSVYTGSAEPPRTSTPTLQSITKMGAYPLQRAGAFADYLNKTGKRMSTLFATESMGYVEKVSGMWKGERKHYDEPAGLRPDEDELEEDDDGQIKTSNERFRAHFALPDTERLQATYFGYIMRVLPLYGKIYLSGRYFCFRSLLPGTRTKLILPLKDIENAHKEKGFRFGYSGLVVVIRGHEELFFEFRQAEIRDDCAVTLLQCLETDRNLQESGILEQHYKHEASAAAAERDALKLATGDVFADRELQLAQSTASLSQAPNILGDDMETSVIQFKSPHPMRITCLTIGSRGDVQPYIALCKGLLKEGHKPRIATHAEFQGWIESHGIEFACVEGDPGELMRLCIENGTFTLSFLREANATFRGWLDDLLDSAYKACEGSELLIESPSAMAGIHIAEKLGIPYFRAFTMPWTRTRAYPHAFIMPENKMGGAYNYMTYVMFDNIFWKATAHQVNRWRNKTLGLPNTGLEKMQPNKVPFLYNFSPSVVAPPLDFSDWVRVTGYWFLDEGGDYKPPQELQEFISKARADGKKIVYVGFGSIIVNDPAKMTQEVIDAILKADVRCILSKGWSDRITTGRDEPTGPPMAEPVMPPEIHVIKSAPHDWLFRQIDAAAHHGGSGTTGASLRAGIPTIIRPFFGDQFFFASRVEDLGVGVWVKKWGTKSFGRALWEVTRNERMIVKARLLGEQIRKESGVETAIQSIYRDMEYAKSLIKHTDGHLETEEDEDTEESWTFVRGDEPDPDVITTKLSEGLDGVALGNNSKASGKA

SEQ ID NO: 7524 - protein, 1437 aa, Hirsutella minnesotensis
MAFPPPPPAGGHDDVQARVSHKLQKRRRPEPPAVDFPEPLRQSDSSDADEDAHHRDDQPSPLAYVSKRPTPMSINMNQSIFSVIAAAGSRIDFNGRFDDASSDDDAPDEAHQPPKPQDLSQTAILDPSAPREATRRSHKKKLSGHRLLKSISTLPRRRAKSKAKRESSHSSAPMVSHDSSDEPSSPPPPAIVDAENSRAAPVMSRMLQARAELSTRSSFDLDRRSADMARADGDDSTPLAKRLKEIFDFEEAEQVIEEYPCWLLQSVLLQGFLYITAKHICFYAYLPKKANVVAKSGYLSKSGKRNPKYNRYWFRLKGDVLSYYRDPTNLYFPHGQIDLRFGISASIVDRDKDGVHFDVVTSQRTYNFRADSTPSAKEWVKSLQRVIFRSHNDGDSVKISLPIENVIDVEETQMMEFSDTCKIRVIDNDETYAIDEYFFSFFSFGREAINVLKILVEDASTGRQTAGKAIAEQQGLNEPDASLPPTSPEDLKRNGNSDEICTTKLPEPVKATLAPLSPPSNNPSPRASHDVLSRPSHDAPRQTGRRSHESSGVSREPSPRRSFSRSRRSQSRRRLDQSTPNIMESSESNLHYSTDDPSYSNLTISIHDDPSASQILRGSEVFQSPTMRRSPSSSQSIETQNQASRDSRQQIQSPPLVNHAATTGHLAQSSARGSLEQLRPSTPTLNSITKMGAYPLQRAGAFAGYLNKTGKRMSTLLATESMGYVEKVSGMWKGGRKHYDAPAGLRPDEDDLEEDSEGKIQTSMERFRAHFALPEGERLQATYFGYILRVLPLYGKIYISDRSFCFRSLLPGTRTKLILPLKDIETAHKEKGFRFGYSGLVLVIRGHEELFFEFGQSDARDDCAVTLLQSLESSRFLRESGILEEEQREEEESAMAERDALKSARQGEFPEHDVQLPRQASGLPNAPTILSDETDGSFINFKPQHSMKITCLTIGSRGDVQPYIALCKGLLAEGHKPRIATHAEFQGWIESHGIEFARVEGDPGELMRLCIENGTFTLAFLREANATFRGWLDELLDSAYHACEGSELLIESPSAMAGIHIAEKLGIPYFRAFTMPWTRTRAYPHAFIMPEHKMGGAYNYMTYVMFDNIFWKATAYQVNRWRNKTLGLPNTSLEKMQPNKVPFLYNFSPSVVAPPLDFSDWIRVTGYWFLDEGSEYEPPKELHDFIKKARQDGKKLVYVGFGSIIVNNPAKMTQEVIDAVHKADVRCILSKGWSDRISPKDDPAKPRADEPEMPPEIFVIKSAPHDWLFNQIDAAAHHGGSGTTGASLRAGVPTIIRPFFGDQFFFASRVEDLGVGVWVKKWGTNSFGRALWEVTRNERMIVKARVLGEQIRQEQGVEHAIQSIYRDLEYARSLVKCKTGKNAQLENEDEDEDETEESWTFVGADEPDPEVMTKKLSEGLGGVSGKSLGSQAIKGNA

SEQ ID NO: 7525 - protein, 408 aa, Kribbella sp.
MRFVLASWGSRGDVEPLAGLAVALQELGAEATVCAPPDEDFEALLERAGVPMVPLGPSVRSVVTAPKPATGHPAFALAPRLVAARFETLSAVAPGCEAIVATGLMPAGARDVADKLGIGYVLAAFHLGGIPSQHFSPGARPGTPSPVDETDRRVLWQHDAQRVNELYGSALNSRRAAIGLPPVENVRDYVFTDHPWLAADPTLCPSKGMTDLDVVQTGAWILPDDRPLPDELQAFLEAGEPPVYVGFGSMAAHAPKDIAQTATEACRAHGRRVLLSRGWGDLAGDGEDCFTVGEVNQQALFPRVAAVVHHGGAGTTTTAARAGAPQLVVPLIADQPYWASRVTALGIGAAHEGSVPTVGSLSAALATALAPQTRDQAAKVRDAVKVDGATVAAKLLLDGAARGQSTGR

SEQ ID NO: 7526 - protein, 823 aa, Talaromyces islandicus
MEDQPPRYSMLEAAGWPDDSWLQNGRNVNDDGRIEVDLDSKVCRTVANLIPIPHEVQGPASVADCTEPVTCDVQLNIVIQVVGSRGDVQPFIALGNELQLYGHRVRLATHSVFESFVLQAGLEFYPIGGDPSELMAYMVKNPGLIPQMKSLRSGEIQRKRAMVAEMLQGCWDSCICDDPVSQAPFVADAIIANPPSFAHVHCAQALSIPLHLMFTMPWSSTSAFPHPLANLKYSTTEPKMANYISYGVVEWMTWQGLGDVINEWRSSLSLEPIPGTEGPCLAETLKVPFTYCWSPSLMPRPSDWASNIDVCGFFFRAPPDYTPPPDLDSFLRKGSPPVYIGFGSIVIEDPIAMTNMILQAVKSIGIRVIISRGWSNIGEASSDDQVFYLGDCPHEWLFQHVTAVVHHGGAGTTACGLRFGRATTIVPFFGDQLFWGNLVASCGLGPRPIPYQSLTSQNLAEAIQFCLRPEAQSAAHDVASRMSHENGVAAAVASFHRNLPLNDMRCDALPSQSAVWQLENPSKPPIHLSKIAAEVLIQHHRLKCSDLQPYFVNPISIQNRRWDPVTGTASSLIGTGTDMLKATGGIVYKPYQEFRRAPKSQPELAVPSPSGSRSPSVASSGNVSSLLASGVNESSRLRTTGVAMEGAAKSLGKVIGYFYKGMLVDMPLAATEGLRAVPRLYGDEVKDHGTVRDWKSGATLAGKNFVHGMADGFSDIFTQPYKGGQEEGAKGVMKGLAKGTLGATTKVSSAALGLVAYPAHGIMKSLYTITHSKTQKRILQARIQEGKYLAEHSDKGQKHYRTIIRNFETAYRKNFGNTVDSTS

SEQ ID NO: 7527 - protein, 419 aa, Clostridium beijerinckii
MRVVFLTLGSRGDVQPYVALAKELIKTGHESIICTGATFKNFVQENGVEFYKAESDLMAILESDEGREIFNGGRYNIFKMLKYAKEVINPAYRKSMDDFFAASKGCNLIIYHPKALGAVDIAEYLNIPCICMPPVPIIYPVTEFPNLAISPSKNFGPFINKLTYKVNSFGEASYMKYINDFRSKSLHLKNRKAGELLFQVNGKDIPVVYPISPFLFKEVKSWKDRVLISGFFFLDIGESRIDENLYEFLENGKKPIVVSFSSMPLKKPMVFKEKLIRALKETNNRAIVLIGSSGMRFENQENIFEVEKVPHRLIFSKAKGIIHHGGIGTTAEALLSGVPQLIIPFTVDQPFWAHRLFSKGYSVGTLKEKNLESFDLIKAFKDMENKEYIRNAKEIKNIIESEKGLENAVKYIEKVYKSF

SEQ ID NO: 7528 - protein, 664 aa, Cephalotus follicularis
MQKALSFCSSCAFDEMGSNGVNDGFREEGKFICSSQEVHKELEQNDGISEFKFSEEQSDLSSSQGAGNEETNSRRSSSLPQICQLKELSVASSPRRGFDHCTTVPIGTHVDPLIDKHEITFSRSMTEKKTVPRHDLKLDRLTDREKKKLIVNLVKIQNDGTVEVDLDKSSPAASELFELHSVEGEQFSVNDSFFSEATKSIPRLKIAMLVVGTRGDVQPFVAIAKRLQEFGHHVRLATHANFSTFVKSAGVDFYPLGGDPRVLAGYMARNKGFIPSGPGEISIQRKQLKAIIESLLPACTEPDMETGEPFRAQAIIANPPAYGHAHVAEALGVPLQMFFTMPWTPTYEFPHPLARVPQSAGYWLSYIVVDLLIWWGIRSYINDFRKKKLKLPPIAYFSTYHGSISHLPTGYMWSPHLVPKPKDWGPLVDVVGYCFLNLGSKYQPKEEFVQWIQKGSEPVYIGFGSMPLEDPKKTTDIILEALKDSGQRGIIDRGWGDLGNITEAPPNVFLLEDCPHDWLFPQCSAVIHHGGAGTTATGLKAGCPTTIVPFFGDQFFWADRVHQIGLGPTPIPISQLSVENLSSAIRFMLQPEVRLQAMELAKLIENEDGVAAAVDAFHRHLPPELPISTVSSEDDDHPNPLQWFFLQIGKLCCLPCGSFWEMGN

SEQ ID NO: 7529 - protein, 416 aa, Kutzneria albida
MKVVIMAIGSRGDIAPYTGLAASLRERGHDVAIATQEPFADMARECGAEYRHLSGDMKAELASEDGRKWTENGTGLRNLRATLAIGKRMMHSLGESTLAAAEGADVLMLQRGVMVHGYLIAKATGVPAMGLELFPGMPTAEFPPPMFGTRSLGRWANRELVRLAAPLPTPIDGVLKEFQRKLGLPELGLTRTRFQMLDDENFLMPHGFSPAVLPRPADWRRGADVVGYWWSYQDPNWQPPTELVDFLDAGPAPVFIGFGSMATGEGERLSELISATLRRLPGVRAVVQAGWAGMRVAGDEVLTIGSVPHGWLFPRMAAVVHHGGAGTTGAGVRAGVPAVLTPVLGDQPFWAARLRAIGVSPGSVLFKKLTAESLSELIRQAVTDPGYAARAAEVGARVRAEDGAARVAEALERIPA

SEQ ID NO: 7530 - protein, 1585 aa, Debaryomyces fabryi
MLPKEDRFNSKNSKGTNEAENQATSFYKRFSSSIIPPLSFLSQGTISPNNEEVANDDNAHKDEKTFSDDEDIAHPIGSVGSLNNFVSFLYAGMGKLSEIKGNDASNANDTNDASDVGALKLNDKFTEARNRQVNEPYRGEYKIDYDINESEEGDVESAEDENTLKPKTEDVTPNTGLDPEEHLEKVSDMFFDDKDEPTTALASDPSKGTVLQQSVLKNFDPFLIEQTELLKLKDIKLSTDEDESDAYKIKKKFFRLKVADKLKRVFELSDDDYFYGNYSVWLVRDVLLQGHIYLTKESILFFTFLPKRQNTINASNGAAGGFQHHDDSHDVIQSGSLGMKTALYGDTVFSTPLTHRFWVILRNETITVYNSPTDLYFPITLIDLKSCISAEVIEKGKNESSTSSRPELCRNDSLENSSGDEEAEFSNMLHSNYQLEDNTENLSGGFWFKVVTKKKTHKFHSDSLYSARQWVNNIVKVVFQLHNSNSNNEVIMKIPINNIISFDINEVFGASERTSESNDEKPKVLNVKHIENEAKARNPLLASRMKNELKNKTRKKMKRTSVGEADDLLSENTYFLLFKNGDEVFNTLNEIVSENKDANTFPNKRSSIISTFNNEKGSSWTRPKSFAHRGEEIKTPRAISTLTTDHYQNSIIDQIEEASHRKTANAELASPRSECGLTNSVLSLPQSKIKKFGKTLIAPSRIFSNKSRSGSEKSTPDRSGTTSPVQGINLSLSGLKDLNMAFEASQKNYEVGSTRFSHTDNNNADNISSFEYNTLSKAEALSPQIRSPHPIEAGPLNLTDPSEFEDNRKKNNTLSSIGKSIKAMSSIKSKLAAVNHYEELYENDPYFIRDISAREVDTKHFQERFSFNNKKQLIASYHCHIIRAVPVFGKVYLGDSEICFRSMLPGVSTKMILPLIDVDTCYEEKGSNIAYSGLVIVIRGYDELLMEFSVQKARDDCLAMILRQLEKNHGPGDESSSNNKNSEDDDQCLQKLPSSTDTTKSLAGIKLAQWRIENARLKLFEDKINAAAGLHVPIILEDSPFYKTEIRPSTSFNFTLLTIGSRGDVQPYIALAKGLLAEGHNVTIATHSDFEEWIIGHGIKFKTIAGNPVELMSLMVSHGSMSLSFLKEASSKFRGWIQDLLDTSWKACQGSDILIESPSAMVGAHIAEALGIPYMRAFTMPWTRTRAYPHAFIVPDKKKGGSYNYITHLMFETVLWKGISGQVNKWRREQLGIPRTNLYRLAQYDIPFLYNISPIIFPPSVDFPDWVKVTGYWFLDEGSAEDFNPPKELVDFMNNAKEDSKKIVYIGFGSIVVKDAKSLTKAIVEAVLEADVRCILNKGWSDRKSSPKKDDAEPEIELPEEIYNSGSIPHDWLFPKIDAAVHHGGSGTTGATMRAGIPTIIKPFFGDQFFYSSRIEDIGAGIGLKKLNAHSLSTALKKATSDAKMNLKAKKISERLKQENGVLNAIEAIYYELEYARNLITAKQHENAKHDIKSGVQTPVVNETLDEYFDSDAYDTDFESDHESPNETYQQDNDEDYNTNDDNTTEIEEPSLMDDNDTVRIAPDTGNDTTTLTDVNKEVFNVSAS

SEQ ID NO: 7531 - protein, 1514 aa, Colletotrichum higginsianum
MATPGPAGAATVSFGGEDDVKRRVGKKLQKKRHEPNNTPAMELPERLKDGDDSRDEDLVPTQGPPMFMNMNQSIFGLIAAAGSRVDFHDRFESSDEESADDDDDRRPDHAAAADKAPGLGHFLHRKQRRHNNESDISKTTVLKKDSSSKSEKHRRKISGSKLLRSLPALPRLPRHKSKKEKSKLGQQQQEMESSSHQAPSDASEAYSTQRTDGIREENEGEEDDEEDDDDDDDGDHRLAPVMSRMLEAKAEMSARPSFDVDRRSADQLTYSDSAESNATALARRLQDIFEFDHPEVVIEEYPCWLLQSVLLQGYMYITAKHICFYAYLPKKAHEVVKSGYLSKSGKRNPKYNRYWFRLKGDVLAYYKDPSNVYFPSGQIDLRYGISASVNDKKDGLGFTVVTHHRTYHFKADSAPSAKEWVKSLQRVIFRSHNEGDSVKISLPIENVIDIEDTQMLEFADTCKIRVIDNDETYAIDEYFFSFFSFGKDAINVLKILIEDASSNARDTAKLKAAAAAAASQQQQQQQQQQQHEEEKQPVTASARSSMSASRRAAAPLKLRTSKLPDAVKATLSPLSAQAHSPSALSPRASMDAARSSFDAFRGFRRRSLDLSTIIRDSSPRRSFSGNRRSMSRNRLDDSRHAPHHQDHQGSTDSYVQSSMEDPSYSGMVASSSEDPSASQILRGSDVFQNPTMRRSTSISRTDQDKSQRSRGQRTPPSLAAYSRQHAATTGSINDGDKPPATPTLQSITKMGAFPLQRVGAFAEYLNSTSSKLGSMLATESMGYVEKVSGMWRGGRKHYDAPPEIKTDDEDLYEDAEGKIQTSMDRFRAHFALPETEKLQATYFGYILRVLPLYGKIYISDKSFCFRSLLPGTRTKLILPLKDIENVDKEKGFRFGYSGLVIVIRGHEEVFFEFGQAELRDDCAVTLLQGLETTRYLKETGDLDMEEKEEEENAMAERDALKEARQIEEFHDHELRLPKESSGVSDAPTILFDDPKASFLNFKPPHSMKITCLTIGSRGDVQPYIALCKGLIAEGHRPRIATHGEFKDWIEGHGIEFTKVEGDPGELMRLCIENGTFTWAFLREANSMFRGWLDELLVSAWEACQGSDLLIESPSAMAGIHIAEKLSIPYFRAFTMPWTRTRAYPHAFVMPEYKMGGAYNYMTYVMFDNIFWKATAHQVNRWRNNTLKLPNTSLEKMQPNKVPFLYNFSEYVVAPPLDFSDWIRVTGYWFLDEGSDFQPPQDLTDFIAKARADEKKLVYVGFGSIIVNDTAKMTQEVIDAVLKADVRCILSKGWSDRVAKQDDDAGATGAADAGSKKDEPVMPPEIFVIKSAPHDWLFSQIDAAAHHGGSGTTGASLRAGIPTIIRPFFGDQFFFGARVEDIGVGICLKKWGAVSFARALWEATHNDRMIVKARVLGEQIRGERGVENAIQCIYRDMEYATSLIKRKAGKHAQSEEYDDEEAEESWTFIGNDEPDPDMTTKKLSEMGAPPGLPEPKPLGTRVMRMSPSASQQQVA

SEQ ID NO: 7532 - protein, 432 aa, Cystobacter fuscus
MKLTVLVLGTRGDVQPFIALAIALQRRGHEVRVATSRGFADMVAHSGVRYVPVSADYEEWFQSEEGIRWMAGSDNTAKFMRMLAGEGVGIDSRLKPRMHRELLAACEGTDAIVANLVIEDSAACIAEKLGVPFIPGYTMPMLPTSEFPSPFLSARELPLRAMNRLTHSLLETLYWQGQKRLINAWRAELGLPPTAISMREKLWRAGTPILHCYSSHLVPRPSDWSAANVITGPWMMPPDVRVNAGGVPSPELIRWLDEGPPPIYLGYWRLPSMDKEGMLRLAIEVANTLGVRFAIGASWSAEEIAALRVPASIFITRSVDHDWLFARCSATVHHGGAGTTAATLRAGLPTVICSICNDQPFWGNRVTALGVGYSMPFKQLTAARLTQALRHIQDGAVRDRANRLGELMRREDGTATAVRIIEERLPGAPLLS

SEQ ID NO: 7533 - protein, 1433 aa, Sclerotinia borealis
MAPDEELKKRVSRKLTKRRKEGHQVTMELPERFRDGDDADEDCTAPHGNAYNMNQSVFGMIAAAGSKVDFNARFDAQSSDEEDDSEKPTRQSSESHINESRTDPTTGKVDGHRRKLSESKLVRSFSRMGSRSKSKSSNIARGSRTPSPVGESPQETTTTDIKYPRLQPKDAPVMSRMLDARAELSLRPSFDMPRKSKDLTKLDEDGKPSPDSLAERLMEIFKFQSPEDVIEEYPCWLMKSVLLQGYMYITTKHICFYAYLPKKSNEVVKSGYLSKSGLRNPKYNRYWFRLKGDVLSYYTDPSDLYFPSGNIDLRYGISAMVTDKEKGQDSTHFIVETHQRKFNFKADSAPSAKEWVKALQKIIFRSHNDGDSIKISLPIENIIDIEDSQIVDFADTCKIRIIDNDETYAIDEYFFSFFSYGKEALNVLKLLVEDTTAKKIPEQLLSPLSTTDNSRGSSKRTSIQVGQPHVLPLQTKAPALEEHVRATLSPLLSPGSDSPRTSNDMSGSSSDVYRRSVDLNKHGRRSVDLNPFTMEGRRSTSANSISTRRSLSANRLDREKRTSKQGSSDSYVHSLEEPGSSEAVPSASDETQASASQILRGSDVFLSPTIQRSPSAVYHRNKDDFQSPESRSLASPRKSTDVSPTRTHRPQHAATTGSMNSSNAGQVEISSGPSLQSIVKAGTYPLQRAAGFAGYLNRHSKRMSTLLATESMGYVEKVSGMWKGGKKHYDEPHGMPRDNETSGIRDDDDNKDGATPANRFREHFALPFDEKLHAAYFGYLHRVLPLYGKIYISDRSFCFRSLLPGTRTKLILPLKDIENVDKEKGFRFKYSGLVVTIRGHEEIFFEFNLADDRDDCAVTLLQNVETTRWMQESGLLTMDEKESAETASAEHKALQQARRELHSEHDISMPKEVDGGSPPILFDDPRASILNFKPTESLRITCLTIGSRGDVQPYIALCKGLMAEGHKTRIATHLEFKDWIESHGIAFAPVDGDPAELMRICVENGMFTYSFLREASSKFRGWIDDLLSSAWKACQDSDLLIESPSAMGGIHIAEALRIPYFRAFSMPWTRTRAYPHAFAVPEHKMGGAYNYITYVMFDNVFWKAISGQVNRWRKKELGLQATSLEKMQPNKVPFLYNFSPSVVVPPLDYSDWIRVTGYWFLDEGSKYTPPKELTDFIKKARADGKRLVYVGFGSIVVADSAVLTKTVVASVIKADVRCILSKGWSDRLDKKSANDVEVPLPPEIFQIKSAPHDWLFSQIDAAAHHGGAGTTGASLRAGIPTIIRPFFGDQYFFGQRVEDLGVGILIKKINVTVFSRALWEASHSERMITKAKVLGEQIRKEDGVDTAIQCIYRDMEYANSLIKGKEGKSVDDTLEDSEESWTFIGDDNDPELVRRIHDWESMAHSGTLSDKNAMAWSGSDAASRVVSPARKAA

SEQ ID NO: 7534 - protein, 572 aa, Chlorella variabilis
MTESLDYQAAATAAMEPRRTILLTAMGTRGDVQPFVALGLHLRDARRWRVVLAVPPEYRGFVEGYGLEAEDIGISLQHAVSSSPQGRALRTAGALTAFQATQDFFRLPLLESWFASIRRLLAQLRPDVLLLSGFVAMSGSAALPALLGLPTRVVLSYTIPMLPTAEFGMPLAGTGFTAPAGWINRLQWQALQAAVSQPLHMSRAQRIVDEAVAAAEASAAAGAVGAEVQREVAATFGSSSSSGSSGSSSGASSGASSGASSPQPVGSLAGSAAQPPRSGGIKLGRSLTPGVAPTLYIYSPSLLPKPADWPSHSHVVGPLLLKRQQAPAAAAGGQQGAAVGLPAELQAYLDAAARAQLPVVYIGLGSMLGTVFEAAEVQRLIGCMREAVVAASSQLPLCAVIHTNLLPGSCNGGGGGGAGGGTGPGLQAQARQEQERSGLPPTYFLLQTPVPHELLLPQCDLVVHHGGAGTTQAALLAGKPSLVVPCVPSSDQPFWADLVHRRGLGPPWFPVLRLTAAKLASGIQRGLLHLDRYTAAAEALGREMNREDGVAAAADIIEQCGGAAAAARQQRA

SEQ ID NO: 7535 - protein, 1556 aa, Ustilago hordei
MVGLRPLFGTRASVENVHDSFGKTVELVKSSESDRAPPPQDNQKQSSATPPSFETPIPHNNANKAQIDQHQKEQAEQHHGGNSLAGLLNGAALMSPQDDHSQPEDHRYDHSVDSQAAAPAATSTTDSQHARKSSQDSPGWKQSAKEAESSDQHESQRASSRFGQTLKKLDAKIRTTLGVNPPPTAQEIRSPYSIGTDDHFASRTSLGAVEFLKDASIETMQHLTDDEDDDDEDDDDDLDAADSDHEHEHDDDDDKTVADHGAHDRSKPDVVRIQKDVEELNRVKSDAEKRRSDSLDQTRPGDSVRTKAPVQVSLEEKMKAIIDEFGECPSLSRPNEPEKLLVDLTAVLVKTVLIKGNLFLTNRRICFLAYIPNDQTDAEQSDSSKVEGHGDTHSSDVRAPLDPNVQNPILKSGPAIIHRPGKMRPKRRVWIELRKHSFNAYSASNKLYKPLMSARLNNLYAVLPTDWSQPHIIRFVEGVQYSSIEFKTQEAALDWRKELEAAAFHARNTAEKVRISIPLERVVGMDATPFLQVAKVVHLDVLVGSVNEEEFAVAEKERKEREQRHQLVEHSWSYNNFFVNCPKNPNFKCHITQLAFGVTHNRAAFIDLLREALKSPRATHDPLGFEELLSAVPAPLLDLEGGPDVEDPPSGGNDSSDDQHKRTLAEKFCHAFGLPSLPEELQLVKCELVRTLHTHGTMAIGLQYLLFWRRAVGRGLKIKVPLNDIQGVDTYRSMLWHHHGLVVHIRAHSDMFFDFVSKGNRDMVLSTLKRVVQAKDDNKKEADGASFVTTTTTHDGSQDSHTTKIDGDSSTDSQQASKESATEALLRNAEGEVPLFEPDMLAYLPKVVNLDRNSQRDALRILPMRIYCLTIGSRGDVQPYIALCKALKEHGHTPVIVSHPEYRGWVEGHGIEYRGVGGDPAALMKLSVEHRIFSPAFFRESIGKFRVWLDELLRECWEECQGADLLIESPSTMAGIHVAEGLGIPYFRAFTMPWTKTSAYPQAFSVPSIEMGPSYNSSSYVLFDQIMWVATSGQINRWRKHMVGIGPTDWSKLDADSVPFIYNFSPAVVPMPNDWGDRVKISGYWFLDNPESNWSPPKEMAVFLKRAKKDGKKIAYIGFGSITIENAEEVSANIMRAVHQADVRAIVAKGWSGRGGSKPKKKKKQPHPQQQKPQQQHSTSQNDSEDTATEEEHDSEIELPDDVFVVDSVPHDWLFPQIDIAMHHGGAGTTGASLRAGLVTLIKPFFGDQFFWANRVQKLGAGARVNSLGVSDLADALKSAASDRVMVEKAQGVGELIRSEDGVATAIEFLYKNIPLAKRRTQRKIDREASQNSPAGTPSGSVFSNPLSRFSSHGRQPSGSSKADLTSTTLGGTTGNGGKERKDQHRSATLPAKAPSSTLSPAGEEHTIHRSASTIVESPESENPASPSTTSASSLFSSSLLPSLSSLNSLPSSMASTLKEMVTLQSNTTDTTADGEEAAHHTLGERSATTPAGATEMGEETEEQKMARLKGYKNAKAEDIRRRKLLQERLAREKLEKEEKSKLSEVRESEEQSQTT

SEQ ID NO: 7536 - protein, 1860 aa, Tolypocladium ophioglossoides
  MOD_RES (1811)..(1811): Any amino acid
MADHLTYIGSGPYCYANSLAMMLGKGAPSPAVLEFATSSPFGMEIIGGKLVFFDPYGWEPASNLGSALAAAGWESTLTVGKDADDALARLKEALTKGPVFVGPIEMGHLRYQPGMNGPLGADHYVVVLAIDEASAEVELHDPHGHPYATLRVADLMTAWKAESLGYGKPFMMRSDFRQVEEVSEEDVIRRSLANARRWLAMEGVDALSIPPGSSGNGEAASRLAAMVEAGLSGDMRAHLTYFAVRVGARRLADAATCLARVGGDEAARVVARQARLVGSLQHPLVVGDRAKAAALLRRLAPTYEELKVALGKLVVTPGGGLQRQGGAASAKMPSRGLNLSPQQTLTAASPLRQPTHDSLKAGTQPRSVEPSPNLTSLVHPDAQVLISSPSSAAPVSSGASILLATATDVLTARRNLISPAMAFPPDGGPASGDDAHKRVGRRLQKKRRDETSPTVELPEPLRDSDSDEETSPNDVASTRGGPMSVNMNQSIFGLIAAAGSRVDFNERFDDGSSDEEDSQQSAHAHGQREDLSQTVILRPSPTDDNSKRGHRKRLSGHRLLKSIAELPKRKHKAKRESSRLSAPVAPTSDEQSESSEPSQSPAITIQKDDNRLAPVMSRMLQARAEMSSRPSFDLERRSTELSRTDGDDDNDDTTPLAKRLMEIFQFDKPEQVIEEYPCWLLQSVLLQGFLYITAKHICFYAYLPKKANVVAKSGYLSKSGKRNPKYNRYWFRLKGDVLSYYRDSTNLYFPHGQIDLRFGISASVVDRDKDGVHFEVVTSYRTYNFRADSAPSAKEWVKSLQRVIFRSHNDGDSVKISLPIHNVIDVEETQMMEFSDTCKIRVIDNDETYAIDEYFFSFFSFGRQAINVLKILVEDASANQAAGKAGAEQRSASISAQASAQPSPRGSKNASRNDIHVGKIRTMKLPEPVKATLSPLSPRSANPSPRASCDMSTRTSLDAFRQIGRRSHEVSSMMREESPRRSFSGSGRSLSHRRRDDKKSRNMTESSDSNLQSSTDDPSYSNLAVSVDNDPSASQILRGSEVFHSPTMLRSPSSSQTMDKKARGPKELPKQSQPVHPHPHHAATTGHIDQGQFHLDFDPQRPPTPTLQSITKLGSYPLQRAGAFADYLNKTGKRMSSLLAAESMGYVEKVSGMWKGGHKHYDEPAGLRPDDDELEEDSEGKIQTSMDRFRAHFALPETERLQATYYGNILRVLPLYGKIYISDRSFCFRSLLPGTRTKLILPLTDVETAHKEKGFRLGYSGLVIVIRGHEGLFFEFSQVDARDDCAVTLLQGLETSRFLREAGILQQEEHQEEDEAIAERDALKSARQGQFPEHEIQLPQQIACLPDAPTILPDETDGSFLNFKPQNSMKITCLTIGSRGDVQPYIALCKGLLAEGHRPRIATHAEFQGWIESHGIEFACVEGDPGELMRLCIENGTFTLAFLREANSTFRGWLDELLESAYHACEGSDLLIESPSAMAGIHIAEKLGIPYFRAFTMPWTRTRAYPHAFIMPEHKMGGAYNYMTYVMFDNIFWKATAHQVNRWRNKTLGLPNTSLEKMQPNKVPFLYNFSPSVVAPPLDFSDWIRVTGYWFLDEGDEYKPPKELDDFIKKARADGKKLVYVGFGSIIVSDPAKMTQEVIDAVLKADVRCILSKGWSDRISPKDVAAKPRPDEPEMPPEIHVIKSAPHDWLFRQIDAAAHHGGSGTTGASLRAGIPTIIRPFFGDQYFFASRVEDLGVGVWVRRWGTNSFGRALWEVTRNERMIVKARVLGEQIRKEKGVENAIQNIYRDLEYAKSLIKRKAGKSAQVDNDXDDETEESWTFVGSDEPDPDMVTKRLSESYSEPGLGGGRALGSQAIKGQS

SEQ ID NO: 7537 - protein, 1168 aa, Diplodia seriata
MASELNIRDQPARWSPRRSRVPRKSFEVPERLRHGEDEDEDVTAPKTNDPRYTHRSVFDLITHAGSVANLRSRFTHDELSESEEEDNHAAVTQSLGPSALAAARGQDSNKSEEKSDKHRRSLSNRKIIRTIQKLHVKSSKERDDVPADDTMSSSQILTPKPPHIEQDETERAQGRLMRGQLKAKAEMEASAFGSDLRTAHDTFGVGHPVGKGQDDLSQRLMEIFGFDAEEKVVSEYPCWLLQTVLLQGYLYITQKHICFYAYLPKKTKEITKSGYLSKRGRTMWNRSWFILKGDVLAYYNDPTDLYFPRGRINLRYAISAVLMEPKDKAREPTDISITTNQKTYVLRAESAASAKEWVKLLQKVIFKSHNDGDSVKISIPLSNVMEIEDNPVLDYAETIKVGVVDNDDSYAVDEYFFSFFGFGEEAMNLMKVMWDGSSSRDAVTDFTIIPPTIESKDTMSVYDKVSGMWAGGRKHYAEDGQLFDEEARDIVDDSDAVSHNERFRQHFALPDTESLRATFFCNLWRVLPQYGKIYMSDRYFCFRSLLPGTRTKLVLPLRDIENVMKEKSFRLTHQALVVVVRGHEELFFDFSRADIRDDCAVTIHQKLEQVRYLHSSGLLSEENLLQAEEAKAENDLLQHARNPEKQPTLPARIDELEQSGAAVIFDDPQASMVDFTPRESMRITCLTIGSRGDVQPYIALCKRLMKEGHKTKIASHEEFGDWVRGHGIAFEPVAGNPAELMQLCVESGMFTATFLAKAHFTFRGWLSALLETAWKACQDSDLLIESPSTMAGIHIAEALEIPYFRAFTMPWTRTRAYPHAFAVQEKKMGGTYNFLSYVLFEEVFWKATASQINTWRKKTLNLAPTSLKKLQINKIPFMYNFSPSVVAPPLDFSDWVRVTGYWFLDESQNYKPPKELLDFIDRARNDGKKLVYIGFGSIVVEDPRAMEKSIVEAVLKADVRCILSKGWSDRLGKDEKSKVEVPLPAEVHQINSAPHDWLFRQIDAAAHHGGAGTTGASLRAGIPTIIKPFFGDQYFFASRVEDLGVGVHIKKLNVGALSRALWTATHDDRMITKARLVGEKIRKEDGAGEAVKTIYRDLEYARSLIKWRNRPMTEDDLGDDAEEEWTFVDDDNDPELRRLTEEDQAVAKIQAQLKQLRQAGPEPEDVST

SEQ ID NO: 7538 - protein, 1323 aa, Serpula lacrymans
MRAGTQTLIQALQALPWTDEPGDEDGSNAAPQLDSDSEEGTSGEYYNRMASSIHAIYRPVARSRRVDASAPLAGLRGHLSTRTVQEGPYFSEGMVNSEDDGEVEDFEAVTPRPAAHRPEYIKSQPPSSSVVSEAFERNAYSRTGSMTTVRVQRRTRLAEKLKEVFDLNDIDEVLHKEMPCWLLRSVLLQGYMYLTNSHLCFFAHMPAREDQVLKSGSLNKKTQRTKRWIKYWVVLKNDAISWYQSSSDPYFPHGIVDLRYAISCDPSGEKDIRMRTTQRSLVLSADSVPSRDEWVKAIRKVMFKAQNMGDSIAIPYSAVLDVEKSSAMDFSETIEVKVIDKEDNISMDSYFFAYFHDLPAALEQIRDAVRAGRNFVQRSSPQTVVDTTTLRPLPSVPQAIDRARSLPIPDTSKITSGFSLSSLLRPFQDTLPLGRIGSAPDRSEGSEDYTHISKRGDTSFIPITTSPPNISDVSESAKNKHPPSHSTSLNVTTTDHTYPPSTLIGDMSDMAIKDSGSSGSSWNVGVPSWLKGSRKVFSLSSAITSPGDSAAILSTSPVASNVSEVYSSPTPANRSGSGTNDLGYSILETQEATVDLHATEKFKNAFAFDDKETLLGYFTGYIFRLLPVYGRLYVSTNYFCFKSSGPLTARTRMVLPLRDVLTVEKTKAARFGHHGLIIIIKGHEELFFEFGVEDRRNAFVTIVEKQLEDVRKRLHAVEPQPLTQGKRDALILEEFEPRSSSSTDANSIPPPENLADSLPAVMFTSASSTFLTFKPQKPLHFTFLTIGSRGDVQPYISLARGLMADGHRVRIATHGEFKVWIEAHGIEFGYVGGDPAELMRICVDNGMFTVSFLKEGVQKFRGWLDDLLKTSWDACQGTDVLIESPSAMGGIHIAEALQIPYFRAFTMTWTRTRAYPHAFAVPEHKMGGSYNYMSYVMFDQVFWRATSGQINRWRRNVLHLGSTSLDKMEPHKIPFLYNFSPHVVPPPLDWPEWIRVTGYWFLDDAEVGAKKWVPPPDLIPFIDSAHQAGKKVVYIGFGSIVVSNPQAMTRCIIEAIVQSGVYAILSKGWSDRLHVKTGEAAEPEEPLPKQIYAISSIPHDWLFQRIDAACHHGGAGTTGASLRAGIPTIIRPFFGDQFFWADRVEALGIGSGVRKLTVESLTEALRSATTDVKQIDRAKLVGEHIRAENGVATAVEAIYRDLEYARSLIKRTAVEDTSENEANTEDTTVQDTRPSSSHSTLDRRRSRSRYSSGGSARGAPSEDWSVISDQDDLRSSFGSRRSEGKVDRSLTMKRNSLAAAVMSVLPDSLTSSHHRSNSASSQP

SEQ ID NO: 7539 - protein, 613 aa, Oryza glaberrima
MASAAEEAKGVEEGGGGASANGGDNPATATATATASASAAAAASSSSPADDRGLPRSSTMPGGINNVEITNETAGPSNLERSRTERRRQNNPADDPTKQLFDDKISLKKKLKMLNRIATVKDDGTVVVDVPSSLETSTTDGVAYDGYSDVTVEEPLDGADIPVRPPMQIVILIVGTRGDVQPFIAIGKRLQDYGHRVRLATHANFKEFVLTAGLEFFPLGGDPKILAEYMVKNKGFLPSGPSEIPIQRKQMKEIIFSLLPACKEPDPDTGIPFKVDAIIANPPAYGHTHVAEALKVPIHIFFTMPWTPTSEFPHPLSRVKQAAGYRLSYQIVDSMIWLGIRDMINEFRKKKLKLRPVTYLSGAQGSGNDIPHGYIWSPHLVPKPKDWGPKIDVVGFCFLDLASNYVPPEPLVKWLEAGDKPIYVGFGSLPVQDPAKMTEVIVKALEITGQRGIINKGWGGLGTLAEPKDFVYLLDNCPHDWLFLQCKAVVHHGGAGTTAAGLKAACPTTIVPFFGDQPFWGDRVHARGVGPLPIPVDQFSLQKLVDAINFMMEPKVKDNAVELAKAMESEDGVSGAVRAFLRHLPSRTEETAPQQTSSFLEFLGPVSKCLGCS

SEQ ID NO: 7540 - protein, 1532 aa, Madurella mycetomatis
MPVTEPTTSPAGAAALHPHSSSRMAQANKSQAHETPASPPTAPTAAAGQDERAARRVSRKLQKKRRDDQHTPTMELPDRLKDHGDHIDSDEEVLRPQGYGGGLFMNMNQSIFGLIAAAGSQADFADRFEGQSSDDDEGEGGMHKTIAGHGGLRPEPGTQELPLAQTTILHKQGNAGAKAGSRHRRRISESRLLRSVPGLSRLAAKSRSFKSSKGASEAAQPHEAREADSGSSPPSDVSPSIEITRTESRTAPVMSRMLEARAQLAARPSFDLDRLSGEQAPGSDTSESGPSELAKKLKEIFEFEQPEEVIEEYPCWLLQNVLLQGYMYITARHIAFYAYLPKKANRRSQSRAIYPRCGKRNPKYNRYWFRLKGDVFSYYRDPQDLYFPSGQIDLRYGISANITDKDKEGINFTVVTHHRTYYFRADSSQSAKEWVKSLQRVIFRSHNDGDSVKISLPIENVIDIEETHMLDFAETCKIRVIDNDETYAIDEYFFSFFSFGKEAIKVLKILVEGSSSEAGQSDLAEPSSDAQSSKRTSTSGNRDQVANTQGHRTGRISEGVKATLSPMPPVRNASVSPRVSSDRPRSSFDGFRTFGRRSIDVGQSPPLHLDSSPRSFSDRQRSLSRSRQARHERHGSSDSYVHSLGDPSQASLSALVASGSSEDPSASQILRGSDVFHSPTIQRSSSKAQEVLSPTATRPNASETAKEAARPPSAGKQEDPAAAEIDVTTPTLQSIASMGGYPFRKANAFMDYLDRQSKRMSNLLATESMGYVEKVSGMWKGGGKHYDEPAGLKTDEEDAEEDLEERANSEARFRAHFALPESEKLQAAYFGYLIRVLPLYGKIYIGDRHFCFRSLLPGTRTKLILPLKDIENVDKEKGFRFGYAGLVVVIRGHEELFFEFGKAEFRDGCTIAILRNLEATRYLRDSTVLEGAGEEDSEAQVAVAEHKALQRARNEEFHDHEVQLPHQASSSSETPTILFDDPKASFLNFKPSQPMKITCLTIGSRGDVQPYIALCKKLIQEGHKPRIATHGEFKGWIEGHGIEFAMVGGDPSELMQLCIQNGTFTWAFLKEANSKMRGWLDELLRTAWEACQGSDLLIESPSAMAGIHIAEALGIPYFRAFTMPWTRTRAYPHAFIMPGQKMGGAYNYVTYVMFDNVFWKTTAHQVNRWRNQTLGLPNTTFEKMQTNKVPFLYNFSPYVVPPPLDYSDWIRVTGYWFLDEGGDKFQPPKELQEFIDRARRDEKKLVYVGFGSIIVPDPAKMTQEVIDAVLRADVRCILSKGWSDRLPGKGGDNLEVASGDGEKKPEPELPPEIFKIQAAPHDWLFRQIDAAAHHGGSGTTGASLRAGIPTIIRPFFGDQFFFGSRVEDLGVGICLKKWGATSFARALWEATHSERMIVKARVLGEQIRGENGVETAVQCIYRDLDYATNLIKSKAGRNQTRREAAAGNAAAMDGSGAEVMADLDDEEEEESWTFVGGDAEVIDDLTSEGVMKRTVADLEKTPGRAPESRVLGVGIGIGAPCDGTQVEARLSS

SEQ ID NO: 7541 - protein, 1465 aa, Rhinocladiella mackenziei
MANLDTPLKKGSSRKLQKRNPNLNRLPSSHIPSRLRLGADAQEDVTAPTRGHNAPAQYMNQSIFSMIAAAGSRTDFNARFDESSDSDDEIIEKEQTTTEGESHAAPRGTESKAAQAVTRKDGKTSKSQRLLGGRPVQSLERPSSRPARLEEIEPPPRQSPSPQSDATSKSSRSNPRDAPVLSRLITAEAEFQECAEAGEEGSSSPRGQKSRSRRESSPQTLLATRLMEIFGFEKPEQVVAEYPCWLLQSVLLQGYLYITEHHICFYAYLPKKSHTVSKTGYLSKKGRTTSKYKRYWFSLKGDVLSYYSDPSNLYFPSGNIDLRYSMSAGFSSEKSKQKECKDFSVTTDHRTYHFRADSASSAKEWVQTLQKTVFRSHNDGDSVKISLPVDNIIDFEESPVVEFAETVKIRVIESGDSYAIDEYFFSFFSFGQDALQVLGGLLTEAPTGRTSEDLWSPTRRGDTMLSPQAMSSARRHSSDVVSGSPRAQSSPPLKDNVRTTLLPFSLGSDGRMPPGMSGEFSRGDSPSRSSGDFGGEYGRASFDRGRRSGSTSRLDVSKSRRTGRSPLARHHDSEDSYVQSIDKETDSSTAPLSPGVEAQMSASQILSRSDVFHPRAAHRMETFTSLSTEPTRKSSEAGTILSSSPRRETTSPIPIRWMADAAGHASNDRRATAPEDVVFSELERDKKLSRNDPPPTLQDLVKAGTYPLQRAGALADYLKNRSVSMRKLLATESMSYLEKVSGMWAGNRKHYGENEGIVPDDKGIDPEDEEANVGHGDRFRAHFALPTTEKLQATYFGFIHRVLPLYGKIYISNRKFCFRSLLPGTRTKLVLPLKDIENVDKEKGFRFGYHGLVLVIRGHEELFFEFSSAEHRDDCTVTLLHSLETARYMAESGLLAQQDEDDAEIAKEEHRMLQEARRISAGEHHLVLPDTAETIYSHEESPPVLFDDPHASIINFKPTTPLRITCLTVGSRGDVQPYIALCKGLLAEGHKPRIATHAEFGAWVRKHGIEFRPVDGDPAELMRICVENGMFTYSFLREASAKFRTWIDELLTSAWHACQDSDLLIESPSAMAGIHIAEALGIPYFRAFTMPWTRTRAYPHAFAVPEHKIGGAYNYYSYVMFDNVFWKAIAGQVNRWRKKELGLRSTNLDKMQPNKVPFLYNFSPHVVVPPLDYSDWVRVTGYWFLNEAQGWTPPAELTAFIQKARDDHKKLVYIGFGSIVVSDPAALTKTVVDSVIKADVRCILSKGWSDRLGDPAAVKTEVPLPPEILQIKSAPHDWLFAQIDAAVHHGGAGTTGASLRAGVPTVIKPFFGDQFFSGSRVEDLGVGICLKKVNVSLFSRALWEATHSERMIVKARLLGEQIRKEDGVQTAIRAIYRDLEYAKTLIKPRPAIEGSAAIAAADFDDGGDIEESWTFIGDESDPELQRRMHDWESPARGRAPRVSMDRAGLRAVQGVEPVRKHSVKR

SEQ ID NO: 7542 - protein, 1499 aa, Candida maltosa
MSFYKKVTQNLLPNAVHHHHHRQNSSTSTDNEDDLASVRSRSTYQSLSGRLNYDDDDSDDEDDLAKLEDGNFFTGLLNTTTVCSGLGTLNNLKKQYLDEFIKKSGLHQLRPQNSQSHHHHHSNSQTSGQSSDTKDPINRIQELNLYDSSEETSETESDDEYFENESNEKPEETEEEVIADDLEPTKTTATTTTSQTTSTATSTATPTSTLAEETTTSVAAVKIPEEHFKDLNPLQRSVVSNLDPHSIKEGILIKVKTSPDNNNQIDNESQILQQKIHLRLKIADKLQRVFDLSDDDQFIGNYSAWLIKDVLLQGHLYLTKDALLYFAFLPKRFSFLHASEVLETDDSSNIVHKGTLGFKSGKYTEAIINAVTTHRYWAVLRSETLSIYSSSTDLYFPELVIDIKNCLYAEIIDKEKAGREALSPVNRGAFSPNGGSSGASTPRSSTLEDTASELNSMLSGDTFTPTEDNVESGSSDVWFKLVTKKKTYKFHCDSSFSARQWCNNITKLIFQHNNANANSEVLIKIPISNVLEYNKRTLFSEEEDDDIDDSRNDIPLNLSIKYLSTTNSINDEDRKRDKVKKKMKGGEPIMEEVHFLFPKNGVEFFDAFDKVMNSSDKSDTASQVSRKASIASQKTMSTLVPSNNSLVQTVLEFNKADTDYDDSSTLKKLGKTITSPANIFRPSSPFSSKDKGGIDSITSRDSFENESHLQLPRALSEKGLKSLEISFVTSLKKMEEAATRYDKPHFLPTDLPLPTNLGEPTSEKKDSKKKSISKSIKALYNVGSRWSASPAHYVKDDKYFVEKEEEREESQRNFQEHFSTNSKLLASYYGHLIKTFPVYGKFYVSDSEVCFRSLLPGVSTKMVLPLLDIQEVNTSTGSKLTYHGLSLVLRGAEALAVEFGSSKARDDFQETVLGQLEILHANENFRPQPHEWGSNYDIELSKTRMEYTDSERRELQSVDKGSTDVLLAEQRIELARVRMFEDRLMAASGLDVPIILEDSPFFKTEMRPSTSYNITLLTIGSRGDVQPYIALGKGLIREGHKVTIATHEEFGDWIKKNGLNFKKIAGNPAELMSFMVTHSTMSVGFLKDAQQRFKSWIAKLLTTSWAACQGSDILIESPSAMSGIHIAEALGIPYFRAFTMPWTRTRAYPHAFFVPDQKKGGSYNYLTHVLFENIFWKGISGQVNKWRVEELGLPKTNLYRLQQTRVPFLYNVSPTVLPPAVDFPDWIQVTGYWFLDEGSGDYKPPAELVKFMNDAAYDGKKIVYIGFGSIVVKDAKSLTKAVVEAVKRADVRCILNKGWSDRLDKKDQNEVEVELPPEIYNSGAIPHDWLFPRIDAAVHHGGSGTTGATLRAGTPSIIKPFFGDQFFYATRVEDLGAGLALRKLTAKTLGNALVTVTEDLKIIEKAKRVSEKIKHEHGVLSAIEAIYSELEYSRNLILVKDLHNQNYRRHHHAVSGVQTPAYDSDSDDDDDDDTEDDYTEEEEEDEKEDDRDDGTEKSV

SEQ ID NO: 7543 - protein, 1137 aa, Taphrina deformans
MSASSAQSLGSAIHEYDEPTHNIVSGTLREQSEYDKYQSTSLQRLNTSRSDQESVGVGKHDLRSLSELLQRVFTLDVEDSLISHHPAWLLKSVMLQGHLYIMKHTLCFYAYIPKREDVTVKSGYLMKKSRTTSRVHRHWFILKNNLLSYYNDASDLFYPSGFIDLRQAMTAEADIGTSSSTAFGFKLVTSEQEYSFSTDTASSCNEWIKTLRKVIFRLKNVGDSVKITIPFAAVLDVEESDVLHFTDTMKIRIADDHDTFAINEYLFSLITPSYEIINGVKFQMQANQEQSGPKLAPKHSNMTPVFDTSKAAPLYYHSEVKNDMAAWRARATESEDNIEHFAKEVIDQRGRSRRSLSLVNPFRKTKASTSTASPTRLGDSTDTITPQGEVSKPSGVTKLLDKSLRKVGSIATSAYKVPISAIQYPIHSFLSKKASHDDPAIDEALAGSFRRRFGASDEERLLKAFKPFYVQTVPLIGDLYVSDERVCFHNSTPGMKLRIAIPLKEIQKAQKEKGFSFGFSGLILTIRAHEDMFFEFSQGSDRDQCVDFITGALENMDAITERKHARRVLLEEKAESDRCEHMSLENELADLGTTNITQIASLETAADAPAIMFDSPGASMLAFKPAKQLRFTCLTIGSRGDVQPYVALCKGLIADGQKAKIATHEEFRDFVESHGIEFVPVDGNPAELMAICVEHGMFTYSFLKEASQKFRGWIDELLKSSWKACQNTDVLIESPSAMGGIHIAEALRIPYYRAFTMPWSKTRVYPHAFAVPDHNRGGNYNALTYTAFDHLFWKAISGQVNRWRKKSLNLPSTNFDKLAQHKVPFLYNFSPSVVPPARDWHEWIRVTGYWFLDNPDDKEGHKWEAPSHVTEFIKQTREMKKNLVYIGFGSIVVSDPKALTKAVVEAVHQADVRCILVKGWSARSSQREQEEPDQSENEKTSDSEHEFGKDILSLDSIPHDWLFPQVDAVCHHGGAGSLGASLRAGVPTIVKPFFGDQYFFGSRVHELGVGLCLNTLTANSLADALKVCTSDRLIIEKSNKIGAQISSEKGVDNAIENIYRDLEYAKSLVKKDDTSFGQTSESSGDSYDMVEGGDDIDDEDLYDTRTDANGITSSILKPLKSLKTFSPVIFKARKSSV

SEQ ID NO: 7544 - protein, 1420 aa, Termitomyces sp.
MSDPTNLQTLLHAPTVAPPVDTSPEALEMESEPLALPKEVTSTPSRVKRLSAAVEKSVDKLSRSITTRSGRTSPTTPPPAGSRRLFSLSRKGRTKENSGDVEGAQMPLFDPSSPVSNLTPSASRSTLSKSTSGVTPREGFPFFSAPIPIKPALQSEPSNVDSPFITPPSPPPIRPALNPFRGNGSMRAGTQTLIQALQALPWAEVENDEDIVGPDANSSDEEEEPGKLRLASSIHAIHRPLARSKKHNIPYSTQERTSSFSCGLVDEVTEEPEVLSSEEEQEAEDFEETPRLSSSPFPSPPIQSGSILSPDKQKDRPVPRPHPRIIPSRAGSMGTIRLQRRVGLAQKLKEVFELDAIEEVRAEMPCWLLRSILLQGYMYLTNSYLCFFAHMPSREDQILKSGSLNKKAQRTKRWIKHWFVLKNDALSWYQSSSDPYFPHGIVDLRYAISCEADGDKGFRIRTNQKTVILSADSVPSREEWVKAIHKVIFKAQNMGDCVKIAIPYSLVLDVDKSTAMDFSETIEVKVFDKDEDSSVDSYFFAYFHDIPGALEHIRDAVRDYRNQPDRPDFPPIVLDTTQSRLSVNPDRITSLPSESNVTKSSSVFRLASLLRPLRTTQASVPETSPEAEDFTHVSRRPNSLSFVPITTSPKSIEGLPETHRDQTAQSLPNSASEHTYPPSTSNSHIDPDHPSLSRESSSWVGVPSWFKGTRRVFGGSSSSEQTTITTLASVRETYSSITATPSFPTTRSIIGDLTFSILETPDIPVDVETTEKFRTAFAYDEKETLLGYFPGYLYRLLPIFGRLYISTNFFCFKSSGPLTFRTRMTLPIRDILATEKSKATRFGHHGLIIIIKGHEELFFEFNAEDRRDAFIRLLDRQVENIRKRLVQGETNPTSPGKRQALILEEFDATASESDPAPVSASDTLGDSLPAVMFTSASSTFLTFKPAKSLHFTFLTIGSRGDVQPYIALARGLMADGHRCKIATHGEFKDWIQSHGIEFGFVGGDPAELMKICVENGTFTVAFLKEGLLKFRGWLDDLLKTSWEACQKTDVLIESPSAMGGCHIAEALGIPYFRAFTMPWSRTRAYPHAFAVPDRKMGGSYNYMSYVMFDQVFWRATAGQINRWRRNLLHLPSTSLDKMEPHKIPFLYNFSPSVVPPPLDWPEWIRVTGYWFLDDAEVSSKRWTPPSDLVDFINSAHRLRKKVVYIGFGSIVVSDPKTMTHCVVEAVIRSGVYAILSKGWSDRLHVKTSEASEPEEPLPEQIYAISSVPHDWLFQRIDAACHHGGAGTTGASLRAGIPTIIRPFFGDQLFWADRVEALGVGSGVRKLTVNSLTDALIVATTDVKQIDRAKLLGEQIRSENGVSTAIESIYRDLEYARSLIKHVDNDDESNDHTTFKPEFIQRDFCEPITQIPPSLTFWSLT

SEQ ID NO: 7545 - protein, 1435 aa, Phaeoacremonium minimum
MELPDRLKEATDDAEQEEDVFPAAQRGGGMFMNMNQSIFGLIAAAGSTVDFNHRLEGNSSDEDDDEDDEASSHHGRKGKAAMGVDGGVAQTTVLRKPSGKGEKHHRRKFSDSKLLRSLPTLSRLSTKHKAKKLEGKKPTVQIQEESEPESSATDSPTLGVQDENRLAPVMSRMLEARAEATSRPSFDLERLSGERGRIPGAMGDTGPTDLSKKLMEIFQFEEPEEVVSEYPCWLLQSVLLQGYIYITSKHICFYSYLPKKSHEVVKSGYLSKSGKRNPKFNRYWFRLKGDILSYFRDPSNLYFPSGQIDLRYGISASITDKDKDGVHFSVVTDHRTYNFRADSAPSAKEWVKSLQRVIFRSHNDGDSVKISLPIQNIIDIEETQMLEFADTCKIRVIDNDETYAIDEYFFSFFSYGKEALNVLKILIEDSTQQADSNKLGARAVAEEASTSELPSSKRTSMSGSRDKLVPQKIRTARLGENVKATLSPMSPQSPPGPSPRPSGEYTRGSFDAFRQFGRKSLDLARVGRPEAPRRSVSDSRRSFSGNRLGEMKKHPERYSSADSYVQSMEDPSQASISQLVASSSDADQSASQILRGSDVFHSPTIRRSASATRRRPHDHRHGSPSLRPADHGSPHLPHHAATTGHMAELGAGDELQPGTPTLQSLAKMGSYPLQRVGEMAGFVNRHTKRMSTFLSTEPMGYVEKISGMWKGGHKHYDENAALRTDDELGDDDSKSKEDKTLLANERFREHFALPESEKLTATYFGYLIRVLPLYGKVYLSERFFCFRSLLPGTRTKLILPLKDIENVDKEKGFRFGYSGLVVVIRGHEEIFFEFGQANLRDDCAITLLQGLEASRFMRESHVIDRDEQELADNALAERDALQEARQEEYPDHELQMPRQTTEIADCPTILFDDPKASILNFKPEKSLRITCLTIGSRGDVQPYIALCKGLIAEGHKARIATHIEFKDWIEKHGIEFALVEGDPAELMRLVIQNGTFTLAFLREANSTMRKWLDGLLLSSWEACKGSDVLIESPSAMAGIHVAEKLGIPYFRAFGMPWTRTRAYPHAFVMPEHKMGGAYNYVTYVMFDNVFWKATAGQVNRWRNKTLGLPNTNLERMQPNKVPFLYNFSPFVVPPPLDYSDWIRVTGYWFLDEGGQQWTPPKDLVEFIAKARKDEKKLVYVGFGSIILDNPGKFTREIIDAVAKADVRCILSKGWSDRLDPKTSGSSAEDSEKTDGESTEIPLPSEIFSIKSAPHDWLFGQIDAAAHHGGSGTTGASLRAGIPTIVRPFFGDQFFFGSRVEDLGVGISLRKWGANSFARALWEATHSERMINKAKMLGENIRKENGVDTAIQCIYRDMEYAKSLVMKKAGKNAAAAAATDSEDYDDVEEESWTFVGDGDASDELAAEAAVAGVAGGGMTMGSKALGSRLMGARAGQ

SEQ ID NO: 7546 - protein, 573 aa, Helianthus annuus
MNSNPNSGDHQNSGSDVEITSADEPQHHSGLSSESVDISLQNEKPERNKEYKIHGLLGAKFFDTKVPARKKLKWLNRLASVQTDGTVQFEIPDEVKPQNLDFGTKVDTPGASEDHDFDATTIPDFPPLQIVMLIVGTRGDVQPFVAIGKRLQEYGHRVRLATHSNFEEFVKASGLEFFALGGDPKVLAGYMVKNKGFLPSEPSEIHIQRSQIKDIVFSLLPACTNADPDTDVPFNVDAIIANPPAYGHTHVAEALKVPLHIFFTMPWTPTSEFPHPLSRVRQPVANRLSYQIVDALIWMGMRDIINEFRKKKLKLRPVTYLSNPNNSPHDLPHGYIWSPHLVPKPKDWGPQIDVVGFCFLDLASSYVPPDSLVEWLQKGEKPIYIGFGSLPVQDPNGMTEIIVKALESTKQRGIINKGWGGLGNLAKSKDFVYLLDNVPHDWLFLQCSAVVHHGGAGTTAAGLKAACPTTVVPFFGDQPFWGRQVHARGVGPPPIPVEEFSLKKLISAIHFMLQPEVKISATELANAMADEDGVKGAVDAFHKHFGRWKAKTEAAKLARPPTHFSMRRCLGCT

SEQ ID NO: 7547 - protein, 1254 aa, Trichoderma virens
MAPPENERSKPRRQPSSRPPPASEAVVTDGFVLPTLEVPPDAPPAYGSHHDQLQFSRTGFEAGAAVTGDGRVNISINTKNKRLAELLAPSIASQIAAQPSLPPVYKLPSLAGEPGKEPPPRLNVVIQIVGSRGDVQPFIALGKVLKETYGHRIRIATHATFQTFVEENGLEFFSIGGDPAELMAFMVKHPGLMPGLDALKSGEISKRRRGIQEMMLGCWRSCIEAGDGLGPPPEPHRRLEPWDPSAGMPGDPNHQPFVADAIIANPPSFAHIHVAEKLGIPLHMMFTMPWSPTRAFPHPLANIQSSNADDVLTNYLTYTLVEMMTWQGLGDVINRFRESALDLPPLSLIWAPGLLNRLKISYTYCWSPALIPKPNDWGPHIDVAGFYFLNLASSYTPEPDLAAFLEAGPPPVYIGFGSIVVDDPNAMTRLILDAIHLAGVRALVSKGWGGLGVDAVGLPDGVFMLGNVPHDWLFERVSCVVHHGGAGTTAAGIKAGKPTIVVPFFGDQPFWGAMIARAKAGPDPIPHKTLTAEKLAEAIKFCLRQETQDQAQALGRKIREEKGAEAGSRSFHNHLDIDSLRCSIAPSRAAAWRLNQRKTKVRLSPLVAAVLVERRLLKYSDLKLYRPYEYITEDQPPDPITAGATSLVTDISDIGMAIVDMPLDIFKSPRKARERCDAASQASGDESDTGSKPNSIQERSGRKTPTATSQADSTGDSNAAAPLAHSPSLPAEMNRTRSPTVDSAGSRSSSRRRAISAAATMEAAVGTSKNVGRIVTTGVKSPMNFCLGLAKGFRNIPRLYNDDTVRDIEKVTDFNSGVRVASKELGFGLYDGISGLLTQPMRGAQKEGAAGLIKGVGKGIGGLIAKPAAGFWGLPAYVMQGAYAELNKFLSRSVQNYIITSRVVQGERDLQNASEGEKADIISRWKQDADLASVYQKNANSQEREDSRARSGGGSSSWRFSPQEARRQLVAALSESKPQQKPGRTARRSYSPVPRTPDTASAIDTEYEAAIRASVVETSRGDAEEDAMIEAAIRESVKAMRQQGSLPDPVRLPLDSKHHDIFEDEEYKITDEEYQNLIEQAIRESMIGHVGDFSLPSASGAQELDAVDTAIPAHGDEPRSSASVLTPTSDEDADLQRAIEESRKVPPTLPPRTSPSQEQEDGDEDEHFRRAIEASKDEMERARHERTEEEIVMEYVKKQSLAEEEFRKQQLAKGKGKEVSEATNDGDDDDEELKKAIEESLKMSGGSSSAQPSS

SEQ ID NO: 7548 - protein, 1470 aa, Exophiala dermatitidis
MASLDTPPQRSGPRKLQKRNTKLNRLPSSHIPTRLRLGTDAQDDVTAPTRGKNAPAAYMNQSIFSMIAAAGSRTDFNARFDDSSESEDEVIAEEQPAAEASTGPIPEAVADLKEKDAGTSSDQRRRRFSRHRLAQSFPRLSARTAAAKDADPHIRRSPSPESDRTSKSSRSNPRDAPVLSRLLSAEAELQESNEADVATPSSPEGQRSRSRAESTPETLLATRLMEIFGFDKPETVVAEYPCWLLQSVLLQGYLYITKQHICFYAYLPKKSHTVAKNGYLAKKGRTTSKYKRYWFSLKGDVLSYYSDPSSLYFPSGNIDLTYGISAALSTDKGKSKECRDFSVTTDHRTYHFRADTPSSAKEWVQALQKTIFRSHNDGDSVKISLPIENIIDFEESPVVDFAETVKIRVIESEDSYAIDEYFFSFFSFGQDALQVLGDLLTEATPRRTSEDVGSPARKAEAVYTPKSRPTLPRQTSQVRPVSPGAPSTPPLRDSVKATLLPFSPKADGKLSPRRSGELSRGNSPSRSSGELQREYGRASFERGRRSGSTSRLDVSASRRTGISPLARHHDSEDSYVQSLDKETDSSTAALSPRVEAQMSASQILTRSDVFRPPPVNRMETLASMSTEPTRKSSDAGTILSSSPQREASSPIAIRGTAGVSGGFNRNLFQATTEGEAPSSGPNDQKFSKDDPSPTLQDIVKAGSYPLQRAGAFAYYLKNQSASMRKLLAEESMSYLEKVSGMWAGHRKHYGENEGIVPDDRGIDPEDEEANVGHGDRFRAHFALPPSEKLQATYFGFLHRVLPLYGKIYIGNRKFCFRSLLPGTRTKVVLPLVDIENVDKEKGFRFGYHGLVLVIRGHEELFFEFSSAEHRDDCTVTLLHSLETVRYMAESGVLGQQDDDNAEVAKKEHRMLQEARRNSGGEPQLVLPDTAETIYSHDETSAVLFDDHRASMIQLRPPSSMRITCLTIGSRGDVQPYIALCKGLLAEGHKPRIATHAEFGPWVEKHGIEFRPVDGDPAELMRICVENGMFTYSFLREASAKFRSWIDQLLMSAWKACQDSDLLIESPSAMAGIHIAEALGIPYFRAFTMPWTRTRAYPHAFAVPEHKIGGAYNYYSYVMFDNVFWKAIAGQVNRWRKKELGLRSTNLDKMQPNKVPFLYNFSPHVVVPPLDYSDWVRVTGYWFLDEANEWQPPEELVAFIKRARDDGKKLVYIGFGSIVVSDPAALTKTVVESVVKADVRCILSKGWSDRLGDPSAIKTEVPLPAEILQIKSAPHDWLFRQIDAAVHHGGAGTTGASLRAGVPTVIKPFFGDQFFFGSRVEDLGVGICLKKVNVSLFSRALWEATHSERMIVKARLLGEQIRKENGVQTAIQAIYRDLEYAKSLIKPSPAAQGAAASAAGEPDDGEEIEENWTFIGDESDLDLQRRMHDWESPARGQGVPSSIGMDRSTGLRAMQGVEPVRKTAAESQAAP

SEQ ID NO: 7549 - protein, 414 aa, Brevundimonas diminuta
MRFSIHTLGTRGDIQPYLALSRGLKARGHELLIVAPAQFAEMAAAEGVAFAPLPAEFLELLETAEAKKAIGSSGAGFGAGFKLLRYYREIGRKLLDAEWDAARMFAPEAILFHPKALGAPHIAAKLGIPLFLASPLSGFTYTSAFPTPILPFGSLGPLNRVSHALMIHGGRILFAKTIRAWRAEALGASARGKTAPLSGTLYGYSPHVLPKPKDWGADVAVTGYWFLDTPDWKPDAELADFLAAGDPPIYIGFGSIPGVDPQRLASLVVDGLKRAGKRGLLATAGGALGQIEPSRHIHVISGAPHDRLLPLMHATLHHGGAGTTGAALRSGNPTAICPFLGDQPFWARLVVALGVGPKPLVKDAMTAEDLASAFLAMDDVGMRARAAEIGTAIRAEDGVAAAIDFIERKLNQAR

SEQ ID NO: 7550 - protein, 2798 aa, Pseudogymnoascus sp.
MVKKESEDSTATTAKMESKDSKMSAFERKRLENIAANQAIMKDLSTTAKKIIPKAAPKPARSKTPRKREPPVKREATRPTRTSSRIAGLEADGEGAKRKFEEEFQFAKDDAKAKKMRVAGDLNLSDIAVEGKKWTNDDNFLSSIMRGAQPYERTFDDSDIKTTTNEELKSLREKMSRLELYKAWEPNDIKITPERIYSMGFHPTHDKPLIFAGDKIGNLGLFDASQKGEVDDDGDQTEAPVITAFKLHSRTITSLLFPANHTELYSGSYDSSIRKLDLQKQVAVEVYAPPSMDDDEAISAIDMNSNDPNLIYFSRLDGAFGRHDMRTQKDTEIWYVSEKKVGGFSLHPLHPHLVATASLDRTLKIWDLRKSTGKGETRQPGLLGEHTSRLSVSHAAWSSSGHVATSSYDDTIKIHSYTKAKTWGVGHTITEEDMEPTAVIRHNNQTGRWVTILKAQWQQRPDDGIAKFVIGNMNRFVDIYTSEGEQLAQLGGEGISAVPAAAEFHPTRNWVAGGTASDKRAGIMIRSHEDVKKRVGRKLTKKRREDRRVTMEIPERFEDGDDADEDCTAPKGQNGLINQSVFGMIAAAGSQADFHARFDGQDSDDEDDETTEPDDAIRLSEASSDPTTSKASTDERRSRHMFHRRNLSDNKLLRSLSQLGSKNRTKHTQLSTASSDPVTPEKIKDTERDHAARSPFKGPPIMSQMLEAKAAAVQRASFDSRRSDYIPGQSVGADGAEGSPSDLAIRLMEIFEFESPELVIDEYPCWLMKSVLLQGYMYITEKHICFYAYLPKKSNEIVKSGYLSKRGLKNPKYNRYWFCLQGDVLSYYTDPSDKYFPSGNIDLRYGISASVVDKEKTFFEVITNHRRYQFHADSIPSAKEWVKALQKIIFRSHNDGDSVKISLPIENVIDVEDSPVIEFAETCKIRVIDNDETYAIDEYFFSFFSFGKQALNVLRTLVSDSAAKQIPEDMLVQPQGNSGGNSPKAGSSRPSLAISTRESKPFLNPAKATTSGLGESVKATLAPLMSSPLHVHSPRGSGEFSRTSFDINRSSSQTRASRRSMDVSRLNLDGNGRNGSPSNDRRSFSRNRLPEKKNSEKQDSSDSYVHSMEESSAAAQSASEDATGSASQILRGSEGFFQPTIHRSASASRRRDDAQLLGGPSLPQSPTALPHAATLDIYERPKLTQGDNASSPSLQTLAKAGAYPLQRAAGFANYLNRHSKRMSTLLATESMGYVEKVSGMWKGGKKHYDEPLGQGLEDDTDDEGGQSDGAEHRFQAHFALPAGEKLQAAYFGYFHRVLPLYGKIYISNRSFCFRSLLPGSRTKLILPLKDIENVDKEKGFRFGYSGLVVVVKGHEELFFEFRQPDARDDCCVTLLQNLETIRYLKESGLLTQEEEDSAAWAVAEHKALQEARHESRQHNHDLELPTTAEGASTDLAPIMFDDPRASILNFKPTESLRITCLTIGSRGDVQPYIALCKGFIAEGHRPKIATHVEFKDWIEGHGIEFAPVGGDPAELMRICVENGMFTYSFLKEASTNFRGWIDDLLSSSWIACQNSDVLIESPSAMAGIHIAEALGIPYFRAFTMPWTRTRAYPHAFAVPEHKMGGAYNYITYVMFENVFWKAIAGQINRWRKKELSLPRTSLEKMQPNKVPFLYNFSPSVVVPPLDYSDWIRVTGYWFLDEGTDYTPPKEISDFIAKARADGKKLVYIGFGSIVVSDSAALTKTVVNSVLKADVRCILSKGWSDRLDKIGATEPEVLPEEILQIKSAPHDWLFTQVDAVTHHGGSGTTGASLRAGRPTIIKPFFGDQFFYGSRVEDLGVGIYLRKLNVSVFARALWEATHSERIIAKAKRLGEHIRSENGVDTAIQCIYRDMEYANSLIKRKSGSHEGLAEDIEESWTFIGDDNDPELMSRIHAWDPRVVLAHSKDMTEPQSKDVTDSPAPIELIPHAFADCFKPKEETKMGKPLNLGKKLKYPITVNKLLKSPGDSFAKGDAIFEYSFKWKKEVGDAFGDRWEEEITTIVSFASTADGKLLRWAIRPGLVIHHDQSCAEIDETCSHAVQYAGLCALCGKDMNETSWATDTVDAQRAQINMIHDQTLLSVSQDEASRAEEQLQRRLLKNRKLSLVVDLDQTIIHACIEPTIGEWQRDPTSPNYEAVKDVKSFQLHDDGPRGLASGCWYYIKMRPGLAHFLATIAEKYELHVYTMGTRAYAQEIAKIVDPEHKLFGDRIISRDENGSLTAKTLSRLFPVDTKMVVIIDDRADVWPRNRSNLIKVVPYDFFIGIGDINSSFLPKREETPKVAPAPPPAVAVESIPDTEETTETESTVDDAEGQAQVRRDELKSKAASTDTTESMSALEELVAMGGGDDPTIREIQAQEQAEFLEKQLKERPLLHMQQQLDKEDNAEGEEATNGTAEESENTDDSAYHHHRHHLLKDDDNELAYLENHLLGLHRTFYEQYDKALINAKGDRVAHLRPGATRKVQMKDEAADLQIVPDIGEVMPLIKANSLRGTSIVLSGLVPLGVDVLRSEIAIQSMSFGAQIHTKISRKITHLVVAANRTRTQKVRQATSYPHIKIVNQQWLVDSMSRWEKVDETPYLINIHREDKSTQPELFSDGRSLDDSSGDDSEGEGRSSHDDADVPDDFEGDQSPIEGLKDVDWSGVDAELEEFMASGSESESESVASNTSDRSQQSTVSIRRKRKLDSKDGEETDEESNISKKQRLARNRTTGLKTVKTPNSASGSSLPTPEKTAAEDGDETHQTDTQDEEFDNDLEAEMIAEFEKGDWDSPEEGDDDSGGGGG

SEQ ID NO: 7551 - protein, 1473 aa, Capronia coronata
MASLDPPPKKTGGRKLQKRNPNLNRLPSSHIPSRLRLGPDAQDDVTAPSRGRNAPAAYMNQSIFSMIAAAGSRTDFNARFNDSSESEDEIAEEEQTTAPGDRPEASTSAPVKNEPAKEEDTQSEPTDQRSPGHRIVRSLPRLSARALKRKDKDRPSQQSGSPDSDKTSESSRSNPRDAPVLSRLLSAEAEFQESGGNDTQREPGSDAQQPRTRAESSPQTLLAARLMDIFGFDKPETVLAEYPCWLLQSVLLQGYLYITKQHLCFYAYLPKKSHTVAKNGYLAKKGRTNSKYKRYWFSLKGDVLSYYTDPSNLYFPSGNIDLTFGISAALSTEKGKRKECRDFSVTTDHRTYHFRADSPSSAKEWVQALQKTIFRSHNDGDSVKISLPVENIIDFEESPVVDFAETVKIRVIESEDSYAIDEYFFSFFSFGQDALHVLGELLTEAPARRRSEDVFSPIRRAESPSSPQSRPAELGPGSPGRPSTPVLKDSIRATLLPFSPGGDGRMSPRKSGELSRGASPSRSSGELPREYGRASFERGRRSGSTSRLEVSASRRNGRSPLARHHDSEDSYVPSIDKETDSSTAPLSPRVEAQMSASQILTRSDVFHSRPANRMETLASVSTEPTRTSSDGGTILSSSPHREAASPRAVRGMADVTGHSPRGARAPVHNEATFPDNDKKVGKDDPSPALQDLVKAGTYPLQRAGAFAYYLKNRSVSMRKLLAEESMSYLEKVSGMWAGGRKHYGENEGIVPEDRGIDPEDEEANVGHGDRFRAHFALPPTERLQATYFGFLHRVLPLYGKIYISNRKFCFRSLLPGTRTKLVLPLKDIENVDKEKGFRFGYHGLVLVIRGHEELFFEFSSAEHRDDCTVTLLHSLETVRYMAESGLLGQQDEDDAEAAREEHRMLQEARRNSGGEHQLVLPDTAEAIYSHAETSAASMGDPGASIINFRPSAPMRITCLTIGSRGDVQPYIALCKGLLAEGHRPRIATHAEFGPWVQKHGIDFRPVEGDPAELMRICVENGMFTYSFLREASVKFRSWIDQLLTSAWRACQDSDLLIESPSAMAGIHIAEALGIPYFRAFTMPWTRTRAYPHAFAVPEHKIGGAYNYYSYVMFDNVFWKAIAGQVNRWRKKELGLRSTNLDKMQPNKVPFLYNFSPHVVVPPLDYSDWVRVTGYWFLDEAQDWQPTEELTAFIRKARDDGKKLVYIGFGSIVVSDPAALTKTVVESVMKADVRCILSKGWSDRLGDPTRAVKAEVPLPAEIFQIKSAPHDWLFRQIDAAVHHGGAGTTGASLRAGVPTVIKPFFGDQFFFGSRVEDLGVGICLKKVNVSLFSRALWEATHSERMIVKARLLGEQIRKENGVQTAIQAIYRDLEYAKSLIKPRPAGPGTSASATGEPDDGGDIEENWTFIGDESDPEMQRRIQDWESPRRGRAGPRWSMDSPAPATTPGPAAAAAAPAAGLRAMQRVEPVRKGR

SEQ ID NO: 7552 - protein, 1270 aa, Fusarium fujikuroi
MAGIVDEKAAAGRQHQPRDGDNRNTGAVASDDLQLPDINPAEEHGAPPPYGENHDQVHFSQPGFDAGAAITGDGRVNININAKNRRLTDLLAPTLQGQLAPEPEQPELPPAYIPPSLGGLPGQTPPPKLNVVVQIVGSRGDVQPFVALGKVLKDTYGHRVRIATHPTFQLFVEENGLEFFSIGGDPAELMAFMVKHPGLMPGFDAITSGEVSKRRKGIQEILMGCWRSCIEGGDGLGPPPKPHASNAPLDVSLEVPGGPGQEPFVADALIANPPSFAHVHIAEKLGIPVHMMFTMPWSPTRAFPHPLANIQSSNTDDVMTNYMSYTLVEMMTWQGLGDVINRFREKALDLPPLSLIWAPGLLARLKISWTYCWSPALIPKPNDWGRHIDIAGFYFLNLASSYTPDPDLEAFLRDGPPPVYIGFGSIVVDDPNAMTEMIFEAVRLSGVRALVSKGWGGLGADDLGKPDGVFMLGNVPHDWLFEHVSCVVHHGGAGTTAAGIKAGKPTLVVPFFGDQPFWGAMIARANAGPDPIPYKQLTAEKLAEAINFCVKPETLEQAKLLGQKIREERGTDVGGKSFHDHLDTDKLRCTLAPSRAAAWRVRRSQVRLSAFAAAVLVEQGLLQWSDLKLYRMTEYNTEEQPTDPISACTLSLVTDIGGIGMAIADMPRELFKSMSQPKKKNSTAVEAQDGTTPLASGSETSLPAPQGNEPEKTSTPAPSIADTETLGSTISTTAHSNASQPTLSDTASSASRPWSPDQSSTQGSANDKSWKEQIKEAAVKQQQRRASSVNYVNAAVGTGKGVGRVVTTGARTPMNFCLGLARGFRNMPRLYNDDTIRPVEKVTGVGSGVVVAGKEFGYGLFDGITGLVTQPLKGAEKEGVQGLVKGFGKGIGGLIAKPAAGFWAIPAYTMQGVNAEVSKYFAKSVQNYITSSRATQGQREMHEATPGEREDVVQRWNNVKFDLKNFYQWKRKEKVAGKRPEEPRLDSSEAGFERLRTGWRQTKNMSFEERKKLHADKDAWKRGFLDAPVPQSNANDAASIQTSPSEDPELEKAIRASVRETSRGDSEEDAHVEAAIRESIKAVRQQVGSSEAGPLPLKDPSIFEDADYQITDEEYQALVEQAIQQSLGNDVPLPDYSDVPELDATDIVSQTPAQTSTQEDDAELKRAIEASRNQPPPPLPPREENDDELERAIAASREAMEQESNQRSEEDIVMEYVKRQSLAEEEYRKQMAKGNGAAGGGNDEDDEELKRAMEESLKMNRGDASGPSGR

SEQ ID NO: 7553 - protein, 1443 aa, Botrytis cinerea
MAPEDELKKRVARKLSKKRNEGHQATMELPERFQDGDDADDDYTAPNAMNQSVFGMITAAVGPKVDFNARFDAQSSDEEDDSRKPTRQSSESHINYDSIDQKGGGSERHRRKFSESKLIRSFSRLGSRSKSKSSNAVAQGSRSRSRTPSPVRDSHQESTTPDIKSPQLQPRDAPVMSRMLDAQAKLALRPSFDMPRSSKELTEIDEDEETPSTSLAKKLREIYKFETSEEVIEEYPCWLMKSVLVQGYMYITSKHICFYAYLSKKSHEVVKSGYLSKSGQHNPKYNRYWFRLKGDVLSYYNNQADLYFPRGNIDLRYGISASITEKGKGKESTHFTVETHQRKYHFNADSAPSAKEWVKALQKIIFRSHNDGDSVKISLPIENIIDIEDSQIVEFADTCKIRVIDNDESFAIDEYFFSFFTNGQEALNVLKILVEDTTAQKLAQDILSPSAADDSHNSSKHTSIHMSHNKKPHVPPIQTTTPALEESVRATLSPLRSPGPGSPRASTDMSRPSSDVFHRSIDLNKHGRRSIDLNPFQTKSGRSTSANGISTRRSLSTNRLSREKGTSKQGSSDSYVHSLDEPGSYEALPSASDENQASASQILRGSDVFLSPTIQRSPSSGRGKNKDDFQSPESHPLTSPRRSADVSPTRTYRPEKPKHAATTGSMGDSDARQGAISSGPSLQSIVKAGSYPLQRAAGFAGYLNRHSKKMSSLLATESMGYVEKVSGMWKGGKMHYEESHGMPRDDEMSNMKNDDDNRDGVTHAERFRQHFALPPDEKLHAAYFCSWQRLAFLYGKIYLSDRSFCYRSLIPTVKTKIIIPLKDIENVEKETSSRFGYSGLVVTIRGHAEIFFEFALPDDRDDCLVTLLQNIETIKYMDESGLLTMEERESAEVASAENQALIQARHVLHPENHISDISTPKVGDTGSPPILFDDPRASILNFKPTESLRITCLTIGSRGDVQPYIALCKGLMAEGHKTKIATHLEFKDWVESHNIEFAPVDGDPAELMRICVDNGMFTVSFLKEASSKFRGWIDDLLSSSWKACQNSDVLIESPSAMGGIHIAEALRIPYFRAFTMPWTRTRAYPHAFAVPEHKYGGAYNYLSYILFDKVFWTAISGQVNRWRHKELGLQATNLEKMQPNKVPFLYNFSPSVVVPPLDYSDWIRVTGYWFLNESSNYTPPKDLTDFIAKARADGKRLVYVGFGSIVVPDSAALTRIVRDSIIKADVRCILSKGWSDRLDKKGANDVEVSLPPEIFQIKSAPHDWLFSQIDAAAHHGGAGTTGASLRAGIPTIIKPFFGDQFFFGQRVEDLGVGILLKKLNESLFSKALWEAAHSKRMITKAKILGEQIRNENGVDTAIQCIYRDMEYAKSLIKLKEGKSDDDALEDSEESWTFIGDETDPDTMKRIHDWDTMARSGTLSDRHAMTWSGSDLASRALSPARNAG

SEQ ID NO: 7554 - protein, 835 aa, Aspergillus ruber
MSSSKTQTVPDELFLDQPPPPYLEIAEDAAGVQDDGRIEVDLESSACKAAIKLIPWPSEDFDVPPPVYTEVVTSKAKLNIVIQVVGSRGDVQPFIALGNELQKHDHRVRIATHNVFDSFVRNAGLEFYPIGGDPADLMAYMVKNPGLIPKMKTLRGGEIQRKRNMVAEMLQGCWNSCIEDDPLTATPFVADAIIANPPSFAHVHCAQALGIPVHLMFTMPWSHTTAFPHPLANLKYSETSANFANFASYGIVEWMTWQGLGDVINDWRKTIDLEAVPITEGPNLAATLKIPFTYCWSPALIPKPADWASHIDVCGFFFCDPPNYQPPPDLDAFLRSGPPPVYIGFGSIVIEDPERLTAILLEAVRMTGVRAIISRGWSKLGGSSPSTRDIFYLGDCPHEWLFPRVAAVIHHGGAGTTACGLRYGRPTSIVPFFGDQPFWGNMVAAAGAGPKPIKHTLLNANNLADAIRLCMRPETSTAAGNIANMMQAECGVQTAVESFHRNLPWDMMQCQILPDEPATWIYEKSLSKPLFLSKTAAQVLADHLRLDSKDLQFHSPNPIVILNRRWDPITGTTSAAIGTGADLARATTDMFLKPYQEISRGRRNSSRPSTPRTTSSPSIQRADSDSQVPNADEVTRAIEQDPHSGWITTGRAVGAGAKGIGKFLGSYYKGVLVDIPLATTEGLRAVPRLYGEDVKDYNVKDWKSGALAGGRNFAHGMSRGLADIVRQPYKGGVEDGAVGVAKGFAKGTIGLTTKMSSAALGLVAYPGYGITKSIHAAVRTKTRKNIVKARKREGEHRAMIAVASGLDHSAMLRSFEAYKRENTESRPSSRWREPA

SEQ ID NO: 7555 - protein, 1184 aa, Fistulina hepatica
MATVKLQRRARLAGKLKDIFELDSINEVLAEMPCWLLRSVLLQGYMYLTNSYICFFAHMPLREDQVLKSGSLHKKAQRTKRWIKHWFVLKNDALSWYQSSADPYFPHGIVDLRYAISCDPVDDKDFRIRTNQKTILLSAYSAPSREEWVKSIRKVMFKAQNSGDSVKIAIPYSCILDVERSTAMDFSETIEVKVFEKESPFSIDSYFFAYFHDLPAALDQIRDAVRDYRNRPHLDSPQALLDTTVPKGPPMTVDRTASLPAEIPSSVSSPLTPSVSSSSRTGFRLTSLFRMPTLDARSGVPLSRGSSGESSQSASEDFTYISRRPDSFIPITTSPDMEQASETPTQSRIEHTYPPSTSLSPAESPDESSFTRTASATPTQIPAASSFSSLLPISVPLWLRPSRKLWGASGGQLSVLTSSNVKEVYSPHTIEDRRTNGADMAFSVLETPDVRIDTETTDKFRQAFAYDEKEILLGYFPGYLFRLLPIYGRMYVSTNYFCYKSSSRLTSRTRVGFMAIPIRDILSLQKSKGTRFGHHGVIVIIKGHEELFFEYWAEDKRDAFVRLLQRQMEDVSRRLEAGNDSVPTQGQRDALILEEFDAPPHSTDANEDGESGSAPDVGLADSLPAVMFTSASSTFLTFKPKKSMHFTCLTIGSRGDVQPYIALAKGLMADGHRVRIATHVEFKDWIESHGIEYGYVGGDPAELMRICVENGVFTVSFLKEGLQKFRGWLDDLLKTSWEACQGTDVLIESPSAMGGYHIAEALRIPYYRAFTMTWSRTRAYPHAFAVPENRMGGSYNYMSYVLFDQVFWRAISGQINRWRRKLLNLDSTSLDKMEPHKIPFLYNFSPHVVPPPLDWPEWIRVTGYWFLNDADASGKKWTPPPDLVQFIDSAHKQGKKIVYIGFGSIVVSHPKAMTRCIIEAVVASGVHAVLSKGWSDRLTAKTGEASQIEEPLPKQIYPIPSIPHDWLFPRIDAACHHGGAGTTGASLRSGLPTIVHPFFGDQFFWADRVEALGVGSCIRKLTTEGLTRAFSSVTSDVKQIERAKLLGEKLRAEDGVAAAVECIYRDLEYAKSLIKRLDTDDESDHDKATHSSPEGNSGYSSSGSARLGGASSEDWSVISDQDEPRVSSSSRHSGRRRHSDGRDRQAKRHSFAAAVLSALPDALAHSSNKTAPNSPRHNSSVLPS

SEQ ID NO: 7556 - protein, 1439 aa, Exophiala spinifera
MASLEDTSRRRDTSQRTDGHKPQKRNPRFPRLPSPSMPSRLNLGADAHEDVTAPSRGRNAPAQYMNQSIFSMIAAAGSRTDFNARFDESSDSEEEAAQTKPSFVGSKETSVKERQTAPATEAKDDSPSFMKRSKYPSPDHLSENLPPSPARAPKPKDKDKASTPQPELSQESDSASDSGKSNPRDAPVLSRLLTAEAEFTEGDDHPPSMPPSETVPESVLATRLMEIFGFDAPEKVVAEYPCWLLQSVLLQGYLYITTNHICFYAYLQRKSHNVTKIGYLEKKGRTTSKYKRYWFSLKGDVLSYYSDPSNLYFPSGNIDLRYGISAHASSEKRKQKECKDFCLTTDHRTYHFRADSASSAREWVQTLQKTIFRSHNDGDSVKISLPVQNIIDFEESPVVEFAETIKFRVLESEDAYAVGAVDEYFFSFFSFGQDALQNFRTLFPEGDGARTSDELLSGTRKDVSTFSPQGRLNMRNVSPRRTPDNEPTKSSPALQENVRATLLAHPALRSRDISPRMSGEFSHGNSPSRSSGEYGRGSFERGRRSGSTSRLEGNISRRRPDSSFAHHHDSEDSYVHSIDKETDSSTAPLSPRAEAQMSASQILDRSDLFHPPIIQRMTTLASMSSEANSEGGTVLSRSHPNDAASPIPVRGAGTHWKNKHSISQEEGVAHTNTPPTLQDFVRAGSSRLQRAGQLAGFLKNPSKSVLKYLPTEPMSYIEKVSDMWTGDRKHYGDNEGVVPGDKGIDPEDEEANVGHGDRFRAHFALPPTEKLRATYFAFLHRVLPLYGKIYISNRKFCFRSLLPGTRTKLVLPLKDIENATKEKGFRFGYHGLVLVIRGYEELFFEFNSSDHRDDCTVTLLRSLESVRDMEESGMLAKEEEDDAEAAKEEHRMLQEARRSSTGDHQLALPDTAEAIYSHEDARPVLFEGPRASISSSKPTTPLKITCLTIGSRGDVQPYIALCKALLAEGHKPRIATHAEFGPWVLKHGIDFAPVEGDPAELMRICVENGMFTYSFLREASAKFRSWIDELLSSAWQACQDSDLLIESPSAMAGLHIAEALKIPYFRAFTMPWTRTRAYPHAFAVPEHKIGGAYNYYSYVMFDNVFWKAISGQVNRWRKKELGLRSTNMDKMQPNKVPFLYNFSPHVVVPPLDYPDWVRVTGYWFLDEAQTWTPPAELQRFIEKAHKDGKKLVYIGFGSIVVSDPAALTKTVVESVLKAGVRCILSKGWSDRLGDPTAVKTEVPLPADILQIKSAPHDWLFRQIDAAVHHGGAGTTGASLRAGVPTVIKPFFGDQFFFGSRVEDLGVGICMKKVNVSLFSRALWEATHSERMIVKARLLGEQIRKENGVQTAIQAIYRDLDYAKSIVAERASKQGVPADDSVPLDEGDNEESWTFIGDESDPELQRQVQDWESPIRVSVGRASLRSMQGVEPVRKSSVRL

SEQ ID NO: 7557 - protein, 620 aa, Oryza sativa
MGSSGEAVAEWGKEGEGGLRHRWRAEAVGASSSFAEGMGEFVLRSMDARFSGSADADGFPSSRHPGFGHSKSTTATSDCSKGQEHVFVRSYSDRLLKCDLTLDMLSENEKIKIIENLVKIQNDGTLEVDVKRSALIASELSEIDAFGSLSRDIVEAAPGLSKSVPKLKIVILVVGTRGDVQPFIALAKRLQEFGHYVRLATHANFRTFVKSAGIDFYPLGGDPRILAQYMTKNKGFCLAGPTEISVQRKQLKEIIFSVLPACTEPDLDTGLPFRAQAIIANPPALGHLHIAEALGVPLHIFFTFPWTPTNEFPHPLARMPQSATYRLSYLILDLVIWWGTRGFINEFRKKLKLAPIAYFSTYHGSISHLPTGYMWSPHLMPKPNDWGPLVDVVGYCFLNLGTKYQPPQELSQWLQQGPKPIYIGFGSMPLGDEKKVTSVILDALRETGQRGIISRGWGDLGSFSEVPVDVFILEDCPHDWLFPRCAAVVHHGGAGTTAAGLVAGCPTTIVPFFGDQFFWGERIHAQGVGPAPIPIAELTVEALSNAIRFMLDPEVKSRTMELAIAIGNEDGVAAAVDSFHRHLPAELPLAPPPTDVKEEQLDFFQWFSQALEKCCFPFNP

SEQ ID NO: 7558 - protein, 810 aa, Eutypa lata
MERDSLEREATRTPPPEYSSIAPEIVLEAKSRLFHTLSRVAAHKDATRPPQATDDLRPTYTSQEKNHPLRLNIVIQVVGSRGDVQPFVALGSELRRRGHRVRLATHDVFDGFVRAAAGLEFYPIGGDPAELMAYMVKNPGLIPRMRSLREGEIRKKRHMVAEMLEGCWRACVEPDPATGRPFVAEAIIANPPSFAHVHCAQALGVPLHLMFTMPWTSTTAFPHPLANIEFGGSSLPVGTVNHISYLAVEWMTWKGLGDLVNSWRTKTLGLDPVPPSEGPRLTETLRIPFTYCWSPALIPKPADWPPYVDVCGFFFRDPPQYDPPAELAKFLHAGPPPVYIGFGSIVIDDPAKLTATILQAVRETGVRAIVSRGWSKLGGSDDDQGGYDYDKRNVMFIGDCPHDWLFQHVAAVVHHGGAGTTACGLLNGRPTTIVPFFGDQPFWGAMVAAAGAGSAPIPQRQLNSKNLAEAIRFCLTPEASVAAERLGAQMRTESGVKAAVDSFHAQLPMRELRCDILRDRAAAWSYRQGRTEIKLSKLAAEILMDNLKISGDELNRYDSMSIVIDPTRWDPVTGTTSSLISTFRGMVVSASDIVIKPVQVYHHSSQRNSLSSTRSEGMLDPAAIHNASKTTTRPNTSYKERDHDNPGEGTTANPSSPSTAQSLPIPSSSSFSSSSPSSHRSHHQHHHHHHQSKLAAEAIAGSAAGLGGFFKYFFKGMIIDMPLAATEGLRVLPRWYGGEVREIGPVADWKSGAVAAGRNFKYGVADGFADLVREPVKGGQEGGALGAVKGVGKGSVNMISKVSSVMELMS

SEQ ID NO: 7559 - protein, 1227 aa, Eremothecium gossypii
MLKGQKEGEAEPVPEGDKSGAGSSPSGVRKGLRVPLGLVSHSFSSLAKHKEAERRLTDEEESLSSPQDREDDAASPNIMAKSIAGLLTTASMYVGIGDIHRAEQLATGQPETDAGADETEDEMDEAGDETGDDADAPATGTDGEEESRPVSAQESRRSTLFELSIEPHPESHTAQASRTKNRRSRMTSKLRSKFNLDDDEELVREYPCWLLRDVLIQGHIYLTSRNLLFFAFLYKSNGSARLTGNLSICNNGLSISGISGKPTRYWTVLKDHTLSLYSSSTDLYFPVLTIDLRYVTKVQHCKNNGKDTRQFHITTESKTYTFYSDNEHSARSWSSALKKQVFATQNSDNDSMSVRIPLSNIIDVEEQAIVEQGLTLRVRVMESSDSFALDDYFFMFFNNAGSQLKELIQIQVANLEMLGAANVDYARHPLPPDTEASLPAVASDAAPQDAAIASEAAADAAAADTASHSPSTNAEPRARGRSTERAMAASAYLFGRLTSPRRDDAKQLSPSKVKLRFRSVADTLKLTTPRQPGSDAPQEPEPETTILESRPRLNYWSPRPFTTMRSMWNAQPVHYAAKGMSLFADDDELMIGDEAELLAADKRFKAHFSLTDDESLVASYYTYLNRSMPLYGKIYLGKTIMCFRSLLPGSKTKMILPLHDVENCYKEQGFRFGYFGLVVVIYGHEELFFEFASQKSRDDAEYVILKIIDSLKPVDGVMADDMSAGAYSLKAAQGRDATTDAKVKLFEQRISSVGYDIPIMVEDNPFYKTTITPKKFYTFGMLTIGSRGDVQPYIALGKGLLQEGHRVVVISHAEFGDWVRSHGLQFRAIAGDPAELMALMVQHGSMNVGLIREAASTFRNWIRDLLETAWEACQGIDVLIESPSAMAGIHIAEALQIPYFRAFTMPWTKTRSYPHAFIVPDQKRGGNYNYFTHVLFENIFWKGINSQVNRWRVEKLGLKKTNLEFMQQGKVPFLYNMSPTVFPPSVDFAEWIKVTGYWFLNESSNYVPPQALLEFMAKARRLDKKLVYIGFGSIVVKDPVKMTMAVVEAVVKADVYCILNKGWSARLGGQSQKSIEVQLPNCVYDAGNVPHDWLFPRVDAAVHHGGSGTTGATMRAGVPTVIKPFFGDQYFYANRIEDIGAGIALRKLNACTLSRALKEVTTNTRIIAKAKKIGQDISKEDGVATAIAFIYSEMAYAKSLIKAKRQEDKKAAKEAKQIQNEDSWLLL

SEQ ID NO: 7560 - protein, 409 aa, Streptomyces griseorubiginosus
MTAGSRGDVAPFTGLGHGLARAGHEVTLVTHGRFEPLAARAGLGFHALPVDPRAELESSRGRALHRSTTGVGKLVRVVAMARTLAVEMSDDLVAAARSSDALLLSGSVAPLGHAVAEGLGLPSLGLNLQPLAATREFAPPMLGTGSWGALGNRVAGTALNLAVEQVFGAALPQVRSRLGLPPVGTVTALRARDRQGWPVLHGFSPRVVARPRDWRRGLDVAGYWWPYDADAPLPDELRAFLDTGPPPVFVGLGSATVPDPARVSAAIVRALRLAGLRGVIQRGWAGLAATGDDLLTIDEVPHSALFPHMAAVVHHAGAGTTAAGLRAGVPAVPVPIQFDATFWAARLVALGVAPRAVPLRRLTAEALAAALTEATRDAGRRERARALGARIRDEDGVTPVLDAVNRLGR

SEQ ID NO: 7561 - protein, 812 aa, Aureobasidium namibiae
MRKTYTASTYSNDTLESSRHNTIRASLNDNDWNDSPPPYTLIAGDSNTLTGNDGRVSLDVNSKLARTLSVFIKDRPEQSPPEYQESEIEEFAQPPPLNIVIQIVGSRGDVQPFIALGNELQKSGHRVRLATHDIFRDFVTKPGLEFYPIGGDPNELMSYMVKNPGLIPSMKSMQAGEITKKRAMIREMLEGCWRSCIEPDDATGAPFVADAIVANPPSFAHVHCAQALGIPVHLMFTMPWTATKSFPHPLANIKDNKAEPSIINRLSYAMVEWMTWQGLADVVNGWRETLDLEPVPTTEGPFLAYTQNIPTTYCWSGALVPKPSDWGQHIDVCGFFFRDTPDYKPPQDLQDFLNAGSTPIYIGFGSIVLEDPEKISLIIAEAVRITGVRCVLSKGWAGLSNVSQSPDIFELGDCPHEWLFQHVSAVIHHGGAGTTACGLKNGLPSLVCPFFGDQPFWGEMIHAAGAGPKPIHHKSLSVDNLSEAIRFLTTPEAAEFAHLIAQRMSTESGVQTAVQSFHRNLPRQTIRCDILPHLPAVWTYKTSSKHTIKLSKLAAELLIDRLKIDGKKLGMNELRTYIIENKRWDPITGAASAAIGTTVEGNEDDSRSILSSHQDDADNKSLIATSAEAPNQKKQNQDGKRIAKGFGKAGNTILKGGLIDIPFALAEGLRNAPAMYGDKPRDFGPVIDWKTGGIVAGKGLVFGLYDGISGLVTEPVKGAKKEGALGALKGFGRGLGGMYWKPNAGLAGLLGYTMQGIYKSVYSAIHTGTRKTIAAARREEGILLLAKARGDQSFDLGQIVTAFEEIKKDDCR

SEQ ID NO: 7562 - protein, 1461 aa, Pyrenochaeta sp.
MASQDRGRERTSRKLTKKRRDSRQHLRAMSADMPERFKDGEDAHEDVTAPKRINTMSMNQSIFSMIARAGQQSQTDLGTMQEVDSGDSEDEATQRIPFHSLDGAARLSRLSSANDFQSLPRDVQDERVEKGKHMRALSENKLLRSLPRLKLSSKKEAHPDGQSMEQMSSSQFLPPRVSPEPPVSSPTNVRPPTTKAKFAPSEDIRTEKARAPGRRSSKHGSSAALAKNKGPVTLARRIQQIFEFEEVEEVISEYPCWLLQSILLQGYMYITQKHVCFYAYIPKKHHDISKTGYLFKRGRSKYNRYWFVLRGDVLSYYTNPAELYFPRNRINLQYAISATVLESKKRTEEEMIFVVTTDERNYQFKADSAASAKEWVRSIQKVIFRTHNEGNSVKISLPIQNVLEIEESSILDFADTVKVRVIDNDETFAIDEYFFSFFKNGQDALNVLRIMINDNEHHQAPHSRNERDATTPTLLGLPSRYETSTPPKFRGEKPHVRENVRATLSPLLAPHVGRANVSDVSPRSSVDLNRKSWDVRRSMDASRTFRRPSYETRRPSHEIRRSFSGSRYDRQRGTQPGDRSPLSPRVPDSASATLSLDPGTESSAAIQSMDESNVSASQILNRSDVFRAPEMQSTESSPSRKIDASARHSQDTTRSSGNGRPSVKPLALVKQGNNPPVQIGTHDLEDDVDATQAHARLSGSSSALQDIASYPYQKASGLAGFLRTRSKKMGNLLASESMGYYEKVSGMLAGGRKHYHTAEGLEPHDQVHGFEDDEDAAKAAENFREHFAFHDTEVLQSSFFASLQRVLPNYGKIYISGRYFCFRSLMPTSKTKIILPMKDIENVNKEKGFRLGYHGLAIVIRGHEELFFEFSKAEYRDECAITVLRILENNKYLQDEDSTSSISDSEDEAAKAEYDLLQQARQDIEAENQINVSEIVRAAEHDRIPLIFDDPLASFVDFKPTEPLTIVCLTIGSRGDVQPYIALCKELLKEGHKPRIATHAEFEPWVRKHGIDFAPVDGNPAELMRICVEHGMFTYNFMKEANSKFRGWLDDVCSSSWRACQGADILIESPSTMAGIHIAEALEIPYFRAFTMPWTRTRAYPHAFSVLEKKMGGGYNSITYITFDTIFWTAISGQINKWRRRELGLQNTSQNKMQASLRPFLYNFSPHVVPPPLDWPDWVRVTGYWFLDEGDSYEPPADLKAFIEKARKDDKKIVYVGFGSIVIDDPAALTKTVVDSVLKADVRCILSKGWSDRLETKDASKPEVPLPPEIFQIQAAPHDWLFTQMDAAVHHGGSGTTGASLRAGIPTIIKPFFGDQFFFAQRVEDMGVGIWLKKVNTSVFSRALWEATNSQRMIVKAKVLGQKIRKENGTQVAIQTIYRELDRARSLIKKHAKEDGDHTDEFDEDWTIVEDGEEIDMSHPFEAQQPLTGINQDASRLGGSQLVLGSVVMKGTRSEGVAYRG

SEQ ID NO: 7563 - protein, 1548 aa, Dendrothele bispora
MPRQPTLQPALHDPMAAPPVNTDPVTLGVDDSGTSPSRAKRLSNMFNLSASMPGSVSPPSGHRRIFSMSRKGKVKQQSDDSYTPSTSRPNSPMEDSPFITPPSPPLRPTRPPITSFQGDGSMRAGTQTLIQVLQAIPWTEDPDNDDDIVNHGLTPATDDSESEDEVKPTQPLASSIHTIYRPLARSRRLSLSRSRLPLHEQNETSLPPEPSSSDLDEPAPSDSEQEDTRDFEETTPKISYAPKPMSIQRNSTAAQISKLGLSMTRTGSMATVRLARRAKLAQKLREVFDLEDIEEVRAELPCWLLRSVLLQGYMYITNTYLCFFAHMPSREDQVLKSGSLNKKAQRTKRWIKHWFVLKNDALSWYQSSSDPYFPHGIVDLRYTISCEPIGEKDFRLRTNQKTVLLSADSVPSREEWVKAIRKVIFKAQNMGDSVKIAIPYSAILDVDKSSAMDFSETIEIKVYDKEASDHYSVDSFFFAYFHDLPTALDQIRDAVRAQRTEGGSGSNSSQSHTVLDTTQSRNQLSNSASGSLSTSPSNANGLPERPSSSSLSSFRIASLLRPFSESRSSGSGSGGTAAAAAAGGTSSSSNLSSNNHEERSPSEEFTHIAKRPDSSFVPVTTSGPSTPEDDEEVQTPIATQAQSHARILSSSSSVTPTPSSLSASVDHTYPPSTILADSALSHKKSGSSGSVIVSSASGVAAAVAGVGGSVSASSGGSAYTNWMSVPNWLKPPKPRLFGSASGASADAVPGVNPPGGKVREMYSESGRPGPGPISASSTSSTSTSVTTSRWTGDLAFSVLETPETAIDDDVVEKFRNAFAYDEKERLLGYFPGYIFRLLPVFGRLFISTNFFCFKSSGPLASRTRMTLPIRDILSAEKSKATRFGHHGLIIIIKGHEELFFEFGAEDKRDTFVRLLEAQIEDVRRRLKESGGVAVPTQGERDALILEEDSKPSIIDDDLISSRWNRPDLGGVSSTTTTTMTASPEMNPTMNMTDSLPAVMFTSASSTFLTFKPAKSMHFTMLTIGSRGDVQPYIALAKGLMADGHRVKIATHGEFKEWIESYGIEYGYVGGDPAELMRICVENGTFTVSFLKEGLQKFRGWLDDLLKTSWEACQGTDVLIESPSAMGGYHIAEALAIPYYRAFTMTWTRTRAYPHAFAVPERKMGGSYNYMSYVMFDQVFWRAISGQINRWRRNLLHLGSTSLDKMEPHKIPFLYNFSPHVVPPPLDWPEWIRVTGYWFLDSADVSSKKWTPPSDLVQFIDSAHQQGKKVVYIGFGSIVVSDPRTMTRCVIDAVVKSGVCAILSKGWSDRLHVKAGEASEPEEAIPKQIYPIASIPHDWLFERIDAVCHHGGAGTTGASLRAGRPTIIKPFFGDQFFWADRVEALGVGSGVRKLTVESLTEALINATTDRKQIDRAKLLGEQIRAEDGVATAIESIYRDLEYAKSLIKRSVPDTSEDEDDNEDSTVRHHHRKASDPQSGYTSGGSNWGTTSEDWSVISEQDDLRSSSAGSSHSGYRSRTRRTSITAAMLSVLPDSLVPGSPRKRTISNS

SEQ ID NO: 7564 - protein, 419 aa, Roseiflexus castenholzii
MRPTITILASGTLGDVRPLAALGKGLHDAGFAVALATHPQFAPLVQAQGLAFRSIGGNPSDLLLHDDAALTFDGGVGRGVVATLRYIRSAQAIYARMLDAAATACYGSALIIVSLASCWGQLIATTFGIPCVWAPLQPVTLTIRFPSPLLPVTLSLGARARRLSYTAVELATWLPWRTVFHRWRARAPGPRHMSLDPFALACTSSAPFVYGFSPHVVPPPDDWPPHHMVTGYWFLDHPAERLAPEIESFLAAGDPPIVIGFGSMGGRRPRDDAALALEALRLAQRRGILFGSADVARLAAGRRDVLVVPYAPHRLLFPRVAVAVHHGGAGTTAASLRAGIPTMTVPVGIDQPFWGMRVAAIGAGPPPLPRRRATPDRLAPAIMAATDDLIRVRAAAIGRLIGAEEGVARAVEVVARVMP

SEQ ID NO: 7565 - protein, 1349 aa, Botryobasidium botryosum
MRAGTQTLIQALQAIPWDSDRGEEDAAAPDDTSDEEDARFGKGNFVLASSIHTIHRPVAQARSPSVSNLFHHTGEPQLDDYFATLEEEGAEADFEPDAIRTLGPAPTTQTVSYSQTIGSPRGNLDTFKRELQARKASMATVRLKRRARLAEKLKEVFELQDIDEVVAEMPCWLLRSVLLQGYMYLTNTYMCFFAHMPAREDQILKSGMLHKKASRTKRWSKHWFVLKNDVLSWYQSSTDLYFREGNVDLRYAISCEPSGEKGFKLKTNQKSVSLEADSVPSREEWVKAIRKVIFKAQNLGESVKIAIPYSAILDVEKSSAMDFSETIEVKVFDKTENFMDSYFFAYFHDMDAALIQIREVFNMTRSTIVASGSGIQDTTLVGHRLSVHGTPSIASPERSQTTSALETKSSGGSGFSRLSSLLRPFSSSESTPTAPKSSSVPDTPVIPESDEFMHVPPHTGADNSRSSDATPTPHHIIAAHSAKSAPTVLRWVSSPDSSITTMPGSASTSMLQASQHTYPPPASPTTTPATLGTPDSQGSSWGVPGWLRTKRIFSGASSLVPSFVSSSSSPGEISEVYQANTHANTLDNSFVSETSDQEDTPNHLGYSILETPVGVAASLPDADVAERFRSSFALGEKETLLGYFPGYLFRGIPVFGRIYISNNYFCFRSSAPLAKTRMIIPIQDILATEKQKAYRFGHQGLVVIIKGHEELFFEFNSIERRDSCVTLLENQMDQTRKRLAAGEPALPTRGQQDALILEELEPSTYLNDSDPHPPPELMTESLPAVMFTSASASFLTFKPQKSMHFTCLTIGSRGDVQPYIALCKGLQADGHRTRIATHDEYKDWVEGHGIEFSPVGGDPAELMRICVENGMFTVSFLKETLQKFRGWVDDLLKSSWEACQGTDVLIESPSAMGGLHIAEALQIPFFRAFTMPWSRTRAYPHAFAVPERKMGGSYNYMTYVMFDQVFWRATAGQINRWRRNVLHIGSTNLDKMEQHKVPFLYNFSPTIVPPPLDWYEWIRVTGYWFLDDPDDSAKKKWTPPDSLVSFMRSAQAKNKPIVYVGFGSIVVSNPDEMTRIVVEAIQQSGVHAILSKGWSDRFSTKKDAQTGKETESPLPPTIYPITSIPHDWLFPKIAAACHHGGAGTTGASLRAGIPTIIKPFFGDQFFWADRVEALGIGSGVRKLTVETLATALRTATTDTKQIERARSVGATIRSETGIANAVEAIYRDLEYARSLIKRPHVDSDNNDDSTLTDKRRLSWSLSGTPRSQHRASMASSTESRGMSDEWCVISEEDNARNPSEEVGNPGNTDTVRAAGSGTRRRSIRRDDTVRPARPSTASTGTSVGSSFSR

SEQ ID NO: 7566 - protein, 1438 aa, Stachybotrys chartarum
MAPPPSSPAEASDAGENERLRRVANRLQKRKHQGSPQTPGLPEPLQDSDEDEADDGASSQGPPVFFNMNQSIFGLIAAAGSKVDFTNRFDGDSSSDDESPEPSVKPKPGLPQDLSQTTILEPPKKEKKHGHIRKISGSKLLKSLPSLPKRRSKSKREPSKLSIPIEDPSESSDAPDIPMPPFLPPNSERNRPPPVMSRMLEAKAEMASRPSFDIERFSGEHSRPGVGGDSSLLAQRLMEIFEFDEPEKVIEEYPCWLLQSVLLQGFMYITARHICFYAYLPKKAHVVAKSGYLSKSGKRNPKYNRYWFRLMGHVLSYYRDSTDLYFPHGQIDLSFGISARITDKEKEGVHFEVVTHHRTYNFRADSAPSAKEWVKSLQRVIFRSHNDGDSVKISLPIDNVIDVEETQMMAFAETCKIRVIDNDETYAIDEYFFSFFSFGREAINVLKILVEDAASGARTVDKVLGAAQRGTQDGEAKVSMSASRLHLDIDQAAGPKIPEPVKATLAPMSPTNQSTANPSPRPSADVSRTSLDAFRNFGRKSLDLPSVLESNPRRSFSGSRRSSSRRLEDKQMQKQSSSESYEPSSVEDPSYSQLIPSSVEDPSASQILQGSEVFQSPTMRRSLSANQARQLKQRENSAATEKGFPRASTSSQPGGRLDSRQHQQKAVTPSLQSISKMGTYPLQRAGAFAEYLNKTGKRMSSLLATESMGYVEKVSGMWKGGHKHYDEPAGLRPDDDDLEEDSEGKVQTSMERFRAHFALPETERLQATYFGYILRVLPLYGKIYISDKSFCFRSLLPGTRTKLILPLKDIENVDKEKGFRFGYSGLVLVIRGHEELFFEFGQGEVRDDCAITLLQSIETTRYLKEVGEVGNLEQEKREEEESARAEREALESARQEEFPQHELDLPHDTAALSNAPTILLDDPEGSFSVAKPAQGMKVTCLTIGSRGDVQPYIALCLGLKAEGHHPRIATHAEFQDWIEGHGIEFARVEGDPGELMRLCIENGTFTWAFLREANATFRGWLDELLASAYTACIGSDVLIESPSAMAGIHIAEKLAIPYFRAFTMPWTRTRAYPHAFITPERKMGGAYNWMTYIMFDNLFWKATAQQVNRWRNKTLGLPNTSMEKMQPNKVPFLYNFSPSVVAPPLDFSDWIRVTGYWFLDEGNKWEPPKELDDFIKKARADGKKIVYVGFGSIIVNDPAKMTKEVIDAVLRADVRCILSKGWSDRHAPKEDPSKPRPEEPPMPPEIHVIKSAPHDWLFRHIDAAAHHGGSGTTGASLRAGIPTIIRPFFGDQFFFAGRVEDLGVGVWVKKWGTNSFGRALWEVTRNERMIIKAKVLGEQIRKEKGVEQAIQCIYRDFEYAKDLVKRKAGKNAQQDNEEGEDDTEESWTFIGGDEPDPDMVTKKLSEGLGGSGGGGGGMGAGVTATRDKALGKQVLQSL

SEQ ID NO: 7567 - protein, 1090 aa, Serendipita indica
MIIEKNQSGNVPVDDPPPYTEHMNASDEELAGVIAADQDLTAYKAHGKGLDSKATIAQDGRINVTMNVKKALPGTLPTNYANEIREFAVDPVLLSTSSSDDAEDLGLREGGRVPRLSVVVMIVGSRGDVQPFLALGQELLRHGHRVRIATHGTFREFIKEAGLEFYNIGGDPHELMSYMVRNPGLMPGWTSLTNGDIPRKQRMLSEILNGCWDACSQPDIDGKPFIADAIISNPPAFAHVHCAEALGIPLQLSFTMPWCPTAAFPHPLVNISQSNAEPGLTNYLSYGLAEMMTWQGLGGVINEFRTSKLGLSALNVRSGPGLVDRLKIPWTYCFSPLLVPRPIDWQNHIDVVGFYFLNLASSYSPSTTLATFLASGPPPIYIGFGSVVVEDPEKVTQVIFEATRLAGVRALISAGWGGLGNTQVPPHVFILGNVPHDWLFTKVFAVCHHGGAGTTAIGLQLGKPTIIVPFFGDQPFWGNMVWKSGAGPKPIKPEKLGVERLKAAIEFCMTSAARDGARRLGEQIRAQNGVRNGVRSFHQHLPLLNMRCDLVPEELAVWWDPQHCLKLSALAAQVLNEEKLLNIHKLEIHRSKEYDTGLKSKTPFTGGVVEALLEPKKGLINTTVAIPRSIMHILESFTDEFAHFPALYGSAIREPGRPRDWKSGFKEGGKAFFFGLSDGITGLWTEPVEGYKSGGWKGALVGNMRSYANLAMRPTAGAFSLITYPVRGALMSLQRRDTATERHIRQLRVDQGRDASLQTPKSPRKPHFPPPVPPKDNIPAASTKSPTGEKSGAPHERVPGYDETLMPDNQTLYTDVDEGGLEGEEDMAESKKVKKDKKHSVGIVQREAHFERHLRSLHTVPLDTPGLRDEATRTVIIQAFRVAIKSENVKKRKKAMSKRVQWVITKGGAGTIADVTSQEAQYFAGGQITTAVLTTNANVGRTATGNSTDLDSPSMAAPSFEPHAPRAGPSRLVKPPPAPRAGPSRLVKPPPLPPRQSTSSTTASAQEWTREDEELFIKQLEDAKLRSLSGDVSGTAHADGVGRDDASKRDYEAQLLHATLEWSEAPHIPSSPGFHSPQQSSSSTSTSTPL

SEQ ID NO: 7568 - protein, 1541 aa, Chaetomium thermophilum
MDSSAQPLCRATASPRPSESKDESKQAHAPLSPSEPTATSAASAAAQDERTARRVSRKLQKRRRDGVHTPSFELPERLRETNDEADSDEEVLRPQAYPGGMFMNMHQSIFGLVAAVGRQANFSDRFESLSSDDEDDESPLAKTIAAPRQPSPWRPDHSSSSTTAMAQTTLLPLTARSSSDQHSSSTDTPTRHRRKISENLLRSVPGLSRFAEKLRPSKSSKEKSAKAPHDDSAADRSISSSKSSSAPPTGLAPAIEITRTEGMGEPIMSKLLEARAQVASRPSFELDRLTEEEGRAEGDDGTIGPSELAKTLKHIFEFERPEEVIQEYPCWLLQHVLLQGYMFITTRHIAFYAYLPKKANEVVKSGYLSKCGKRNPKYNRYWFRLKGVVLSYYRDPQDLYFPSGHIDLRYGISASITDKDKEGINFTIETHNRTYYFRADSAQSAKEWVKCIQRVIFRSHNDGDSVKISLPIENIIDIEETHMLDFAETCKIRVIDNDETYAIDEYYFSFFSYGKDAINLLKILIDDSSSQARDASDGPDKSLAASTRTSMSASRDQAQGRPGRLTEGVKATLSPMTPPRCASPVSRASQDRPRSSFDAFRPFRRSIDVAQSSELHPTSPSRSYSKTRRSFSKHRREALHEQQGSSDSFVQSVGDPSQASLSALVHSASSEDPSASQILRGSEVFHSPIFHRSSNKAEDTEEPVSAGIVRHDTDATVKPSTQQGTARQENAVGATATTPTLQSIANMGGYPFRKANALMGYLDRQSRRMSNLLATESMGYVEKVSGMWKGGGKHYDDPAGLRTDEEDGQEDPNERANSEARFREHFALPETERLQAAYFGYMMRVLPLYGKIYIGDRHFCFRSLLPGTRTKLVLPLRDIENVDKEKGFRFGYSGLVVVIRGHEELFFEFSKAEVRDDCAVTVLQSIEATRFLPDSSLLDGADSEDAQAAVAERDALQEARNEEFGDHELQLPRQASSVTEAPTILFDDSATSFLSFKPAQSMTITCLTIGSRGDVQPYIALCKKLLEEGHRPRIATHLEFKDWIESHGIEFAYVGGDPGELMRLCIQNGTFTWQFLKEANAKFRGFLDDLLATSWEACQGSDLIIESPSAMAGIHIAEALEIPYFRAFTMPWTRTRAYPHAFVMPGQKMGGAYNYLTYVMFDTVFWKTTAHQINKWRNNMLGLPSTNLEKLQVNKVPFLYNFSAYVVPPPLDYSDWIRVTGYWFLDEGDNNSKWTPPPELRAFIEKARSDGKKLVYVGFGSIIVPDRIKMTQDVIDAVLKADVRCILSKGWSDRSKNPDQQEQEPELPPEIFQIQSAPHDWLFRQIDAAAHHGGSGTTGASLRAGIPTIIRPFFGDQFFFGSRVEDLGVGICLKKWGANSFARALWEATHSERMIVKARVLGEQIRKENGVETAVQCIYRDLEYATNLIKAKARKNPSRRNTISSGTGEPLPAPANATASNGAEAGVGLGLELGTGGDGPSIDFDDEEESWTFVDRFDDHWDYQPQHHQHGFLRNPALTAPASAAKSLGSKVLGGAVGGGK

SEQ ID NO: 7569 - protein, 1455 aa, Cutaneotrichosporon oleaginosum
MSHRNTQEEQDPPAERSSTATPPEPSGDLSATMPPVPPPPIMTPAMEAQSIPSATFASSSVSDSEQVTQRDASPTTQPSDPDSTPIAPIPGMRFPHFPTPERHGTARPRDYRRIATADEASHDQKLSEMGSIRMGASALISALSALPRDDEESSLSSDEEVSYEVDVTTHLPVRPKMSRMHSSLQTLRPMASMSDPDTHNAHSQPTFLRTPPRSAHSPPHRARSPLGSGRSRPTSPESHHKLTFPYKENVITRRARAPSLTELRYQHAPASPEGAHERLPWQMRVGSSSTLKEIASDLVEPSQEVEEVQGSALGKPERGHLVVEREDTPRMLQRVFGLQEQEELIEEMHCWLLRSDMLQGYMYLTRRHICFFAKVGQTENDKTIKSGPLWKKASRTKLSNRYWVTLRNNVLSWYESPNDPYFPKGNVSLQYALSCDLVDETRFKVRLPERNYTFQSDTASNAQEWVRVIQKSTVKLQHEGQGVKLIIPWEAVYEVERSPTLEFAETIEIKVIDSEDSMSLDSYFFASFPDNDYAYELLQTLLRERPVSELPPPAAPSPKPAERKRDSGSRFSLTNLSAALPIPIPKFGSDKGDSSERVPIAPPMVLDLPYSGHDSFTSHSEADSEMSEDDEATRRRKEYPPRPSGPPPPGMGPASSGWAPADWIRRGSAQLFGTSPGSQPPPPRRRIHRQGSVTEVVEGYSFDSTDESESERRLSGARQSFSKLASTTPESPQPAQEDAIAIKFRKTFALPETEVLIDHISGSLYRVLPVSGRFFVSSNYFCFRSSGLLNKTKMIVPIRQLYGMTAQKAFRFGHHGLIVIIKGHEELFLEFHSASRRDELMALLEERMDDVREASQANKALEAAFPNAQGPFVNDMSDAPETAIGSMFSSTTSSFLQFKPEPMTIVCLTIGSRGDVQPYIALCKGLQAEGHTCRIATHAEYQAWVEGHGIGFAPVGGDPAKLMELCVDNGMFTISFLKEGLQMFRGWLDELLNESWSACQGADLLIESPSAMAGIHIAEALRIPYYRAFTMPWTRTRAYPQAFAVPEHKRGGSYNYMTYVMFDNVFWRAISGQVNHWRKTVLKIESTTFDKMAQDKVPFLYNFSPTVVPPPLDWTEWIHVSGYWFLDNADGKKDWSPPDGIVEFIDNAHARGKKVVYIGFGSIVVSDPHEMTRCVVQGVVDSGVCAILSKGWSDRGSRGKNDHPELTAITSHGADGIEFPPEIFSVDAIDHSWLFPRIDAACHHGGAGTTGASLRAGIPTIIKPFFGDQFFWAERVESLGIGSSLRQLTYEGLATALIEATTNERQIAKAKIVGQTIRAEDGVQRAIEAIYRDLEYARSLIRPEEENLPSRSTLSLSMSNSMSRQGSGSHSRGHSRASSLGDLLIHSHTRTRSTEGARSDESWSVVSDAGASLPSSPRREAHESDSDDHHHRIPVLGSLVSHISSAITRESSSRK

SEQ ID NO: 7570 - protein, 1510 aa, Ustilago maydis
MVHFRPLFGSRASVHDVHDSFGTTLEAVKTSESEHANPFEQHNKDANSPPHEQPVSPQSQQQQGGNDLAGLLNGAALVSRKDSQSKTQQRHNDDAAVALDSSAPPSEDAAGTDLNSPDNAAAWLKSRNQAETWDQHESARARSKLGRTLKKVDAKIRSTIGVNAPPTTQQIRSPYSIGKNDHLTSQDNFAVAELLDEASLETLQHLSTDEDDDDGDDEDEVEDEDEAEVQQNAQLRDQHVNDNDDGTTLREPQLRSDPDKIKGYVDELNQVKQGAKQRRSGSMDGARPGDTVRTRAPVEFSADEKIKAIIEEFGECASASEPNEPEKLIVDHNAVLMKTVLIRGNLFLTSRRVCFLAYIPDAASGNSNSSDYPHPGSVDIRAPSDPNVENPILQSGPAILHRLGKLRPKRRVWLELRKDSFNAYSASNKLYKPLLSARLANMHAVLPIDWSQPNVIRFVEGTTYSSVEFKTQEAALEWRKELEAAAFHARNTAEKVRISIPLERIVGIDAADFMRVAKVLHIDVLVGAVNDDEVLQIEQENRERTGRHQLDRTWSTSDAFFNCPKNPGFKCHVTQVTFGVTHNRSAFIDLLREALTPSRSIQHSTGYKNLLSISPAPLLDLQGEPDVEDVSTDSSYSSDDHKSSLADKFCDAFALPHRPDELHIVKAELVRTLHTHGTIAIGLDYLLFWRRAVGRELKIKVPLNDLRGVDTYRSMFWHHFGLVVHITAHSDMYFDFASKDNRDMTLHKLAGFIQAKRKQSKEGTASHDAPATEAKGDHKSPEAVQNMPGKKVAAEALLHDDESEVPVFEPDVLAYLPKVVNMDRNAMRDSIRISPMRIYCLTIGSRGDVQPYIALCKALKEHGHTPVIVSHPEYRSWVEGHGIEYRGVGGDPAALMKLSVEHRIFSPAFFKESIGKFRVWLDELLRECWEECQGADLLIESPSTMAGIHVAEGLSIPYFRAFTMPWTKTSAYPQAFSVPSIEMGPSYNSSSYTLFDQVMWVATCGQINRWRKHMVGIGPTDMSKLDADSVPFIYNFSPAVVPMPNDWGDRVKISGYWFLDNPESNWTPPKEMSDFLERARKDGKKIAYIGFGSITIEDAEEVTANIMKAVHQADVRAIVAKGWSGRGGSKTKKKKKQQQHKPQLEHKDSAASHPEGEDAATEEEHEPEIPIPDDVFVVESVPHDWLFPQIDIAMHHGGAGTTGASLRAGLVTLIKPFFGDQFFWANRVQKLGAGARVNGLSVSDISDALKSAASDRVMVEKAQGVGEKIRSENGVATAIEFLYKNIPLANRRTQRKLEREAMHESSTDTSHIRTNPLRRLSSHHRQNSSGGERKDSQHKQQRGATLPTVSTLCDASSSSPTSSREEQAFHRSATIFESPANEAGTPQSAGSSSPTKTSSFLATLSSLNPLPASMTASLKETITLNSSTSDTTADGEEAKWFGERSNTSTTLPGALNVGEESEEHKMNRLKGYKNAKAEDIRRRKLLLERLERERAEKQQNQPQRKEEDEN

SEQ ID NO: 7571 - protein, 423 aa, Mastigocoleus testarum
MNIFILTAGSRGDVQPYVALGQGLREAGHLVTVCTCSSFESFITDHGLNYGYMNNDFIKLVDSEAGREMMESGGTFFGLIGAMLKLLKVAKVINKQMLRDAWNSAQAAKPDIIIFHPKVLAGSHIAEKLGIPAIMAVLAPAIVPTSDSVAIGFPNLKLGGWYNKLSYKVLHWGYHNYDDIVNEFRQDVLGISKFPKSTSPIETVNGKPIPVLHGYSGLISPRPKDWSNTAYITGYWFLDRKDDWRPPAELVDFLEAGEQPVYVGFGSMAGRNPKKMANIVINALEKAGVRGIIATGWGGVDARILPKTIFKIDKIPHSWLFPQMSAVVHHGGAGTTAAGLRAGCPTIVCPFLVDQPYWGERVYTLGVGSKPIPQNKLTATKLAKAIREVITNQIIRQNTETLGEKIRKEDGIANAIAIIESFI

SEQ ID NO: 7572 - protein, 1368 aa, Rhizoctonia solani
MSATTSDLRRNKNQASDSRPSLSIMGLGKQDEFGIGSMRMGTQALIQALQAMPWDEDRDEDVPESAAKRGRGKPRREPVSPDSSDEEEQAKADFVLASSIHTIHRPVAHSRLATPSFNQSMHYGINPPLEAAEDYFSNPLSADEDDGLRDFDDAATPEGLPNPFKDPSRMRLHLPADKQPKSEGKRRMPAPVRTASMATVRMKRRVKLADKLREVFGIPEIKEVVAEMPCWLLRSVLLQGYMYLTNTHLCFFAHMPAREDQVLKSGTMSKKAQRTKRWNKHWFVLKNDVLSWYQSSADPYFPHGNIDLRYAISCDAHREKGIRLRTNQKTITLQADSVPSRDEWVKAIRKVIFKAQNMGESVKIAIPYAVIDGVEKSSSMDFSETIEVKVIDKEENYALDSYFFAYFRDLPAALEQIQQVLSDYQATAPPGEAHLTDTTQANRAPVQHLDRTASAPASSHQNDSSSGFRISSLLSLRPFSTATGSEETHKGSTISTLNTNEGVSIQHGPASPEGAALGTSSILSEASVHTYPPSPSHQPPPSTHSNRTSISSNWSVPGYNWLRGKRLFSTPSSIDWGSRSTEGNVSEVVSSPRLDQSELSVSSDGNNLGFSILEAAEDGKAADAGLEEKFRSTFALDEKEALLGCIPGSLFRVLPVFGRLYVSTNYFCFRSSQPLTRTRMMIPIRDILATEKQKPFRFGQHGLVVVIKGHEELFFEFGSVERRDACCSLLEMQKDVLQHQALSPISPTPTQGKRDALILEELEPSMLISDDDPRPAPEVLASDAPVMFASTSSTLLTFKPDRPMHFTCLTIGSRGDVQPYIALCKGLQADGHKVRIATHKEFQSWVEGHGIEFALVGGDPAELMRICVENGMFTVSFLREGVQKFRGWIEDLLETSWLACQGTDVLIESPSAMAGIHIAEALKIPYFRAFTMPWTRTRAYPHAFAVPERKMGGSYNYMTYVMFDQVFWRGISGQVNRWRRHTLRLPSTNLDKLEQHKVPFLYNFSPTVVPPPLDWYEWIRITGYWFLDDPDDSGAKKWTPPPDLIKFMETARRDNKKIVYIGFGSIVVSDPDAMTQCIIEAIKLSGVYAILSKGWSDRLSTKKSNTEPPPTYPPQIYPISSVPHDWLFSRIDAACHHGGAGTTGASLRAGIPTIIKPFFGDQFFWSDRVEALGIGSSVRKLTVENLTAALRAATTDVKQIERAKLVGQSIRAENGVRTAIEAIYRDLGYATELFRKDTHVDLDADGSEDETIQESKTPAARRSSLDPVMFGSDSSCGSGRGNGEDSSWSVISDHPPPERVRVESMGSDKRGGGESGDSSTGESRTPNAGQPSGSRGLSNLPAIGLALLQDTLTAYSPSARGEVPNGKP

SEQ ID NO: 7573 - protein, 1264 aa, Lachancea sp.
MAKKQTPGPGSVILTNTDGLGRRGSTSQRRWMRSLSPVGKLYHSSASLMHFPSKVAGGERSSLAASDGEESNTIETGNRDLEPDLACPRGMAKSIVGLLTTASVYAGMGDMEQAAEICEDDSSAEEEGDDSTVSKSAKNKEQHEHDANEENQELELEPSDNVSPHGDENSTASDSAIDLDSLTDTVTHVSKKDTLFEISVEPNHDATSVVSTSSGSRQLKIYRKLLSRFNLNEAEDEFVLRQSCWLLKDLLIQGHIVLTSRHVLFFAFLPKSTGTAKMSGNLSTFSGGLRGRWSRYWAVLKDHTLSLYNSRQDLYFPLLTIDLRYASRIELDNRGHGATGTFRICTEAKTYKFRADSHFSSRSWSSALKKQLFATHNSENDSMSVKIPLVNILDVEEQMVVAQSVTLRIRVLESPASFAVDDYFFMFLGKSEMNLRQAINAQLSKMEKPPLRQSDLSHLSPPVTELNDGQSEVLDKTARGRSDSNSRKIIRRVLSPVSKVRRPSFPVHVHISQKYPQRALSLLKSKNESESSTKTSSDDTFGGLSHHTLEDTVELGSPQQLQVTADEISDSDESAQTSEDNKLGTSKLASWTPRPIKNMGSMWGAHPVHYRHDLADIFPDDDQYLANAKDQLVASKRFKSHFSLKDDEILRAAYYTHLNKNIPVYGKLYIGTSVICFRSLIPGNKTKMILPIEDLENCYKERGFRFGYFGLVLVIHGHEELFFEFSLPSSRDDAEYVTLKQLDLTKLDVDSPITTVDGISQKLRTADISAEQKATDAGKLRLFEDKINAEGFDLPMMVEESPFYKTSITPKKSYRFGLLTIGSRGDVQPYIALAKGLLKEGHRVTIISHSEFGSWVRSYGIKFREIAGNPAELMSLMVQHGSMNVGLLREASSKFRDWISQLLRTSWQACQNLDILIESPSAMAGIHIAEALQIPYFRAFTMPWTRTRAYPHAFIVPDQKRGGNYNFFTHVLFENIFWKGIGGQVNKWRIETLGLKKTNLMLMQQNKVPFLYNISPAVFPPSVDFSEWIKVTGYWFLDGKDDYSPPKALADFIAQARGQGKKLVYIGFGSIVINNPKKMTKAVVDAVLEADVFCILNKGWSDRLDDNSSSDDIEEPFPECIYSSGSVPHDWLFPQIDAAVHHGGSGTTGATLRAGLPTIIKPFFGDQFFYAGRVEDIGAGINLKKLNSKTLSRALKEVTTSSRMSHKAQQIQQEIAKEDGVETAISCIYSELEYAKSLVQAKYQEKQDDMKDLGSPEENSWFLV

SEQ ID NO: 7574 - protein, 1520 aa, Tremella mesenterica
MSQHNKPPSPKVPPFPPQAIHSDDRRDHDSTAEDLINIAATHIMPVPAPSSSNSPQDKRHQVQAESEESQVVAHARDDREEEPIMAGTPLDELKTPTLERLKLLDLDPETLQPPTSGIEPTHVGTIQEDDAAGDADDEAADELPTLSAPARLGLGTSALISALHALPWDDEEDEGESSSNSSDIEARDRRSPEDSVPAPTKQKQQRPKAPSLQFPFRANTIARRARSPGLDELQYQFAKSGSSGLQAHDNDVPDVPPPKGAFSRRQRQDGDQSSESSSLTDNSSRRLVARRIEKEEHLGAAEEHEEILRTLSDEESDDSQEDVAKKHTQGKLLRNDNTEAALREDQDEEMLEERMSVNPGEKKRVRKERLAERLQEVFGLEEREEVLEELRCWLLRSVMLKGYMYLTPRHICFFAQMPNKENVVVKTGPLYKKATRTKLNSRFWVTLKNDVLSWYESTSDPYFPKGNVSLQYAFACEPVDDTRFKLRTSERTYTFSAETQDGRDDWVKAIKRVMFKTQHEGESVKLIIPLEVVLEVERSPSLEFAETIEIKCVDLEDQMSVDSYFFASFHDLDHTINVIQRLLDARPPIDFPRVDSDLVARVAEAEAEERARSASDSSTNLSSLGSLRKLGSVLKPFVRSSDKVNEVGNESHSRLSLPSMPGLPRLSIPFRPLEISDEDMSEGYPPRQSGPVPAGLGESPSGWAPSWVRKPTAKLFGSSPSSRSFGKSPESTSTLTTSPARMRSGGGKKPVVTEVVEPVIPFNRDSDDSCSEEDSTFRGHGGSGRPRMSFSSDASIGSQMGDRPKSDYSMMEQSMTEKKETDETRRKFLDVFSLPDTEELLDHFPGYLYRVLPVSGRFFISTNYFCFRSSQLLYKTKMIIPLRDLYGLKAQKAFRFGHSGLIVIIKGHEELFLEFSSSSRRKACITLLEERMEAVRLQTDQGEPDVARIRARIMEDLDESAPFDPSNAARPSSPSSLFESTASTLLEFKPESMRITCLTIGSRGDVQPYIALCKGLQAEGHTTRIASHGEYKEWVEGHGIEFASVGGDPAELMQMCVDNGMFTVSFLKEGLQKFRGWLDDLLTSSWKACQGSDLLIESPSAMGGIHIAEALRIPYYRAFTMPWTRTRAYPHAFAVPDHKRGGSYNYMTYTMFDQVFWRAIASQVNKWRKNTLCIESTTYDKLEQHKVPFLYNFSPSVVPPPLDWTEWIHVTGYWFLEKADEHAQKKEWCPPERLLHFMEEARQANKKVVYIGFGSIVVSDPEEMTRCVVDAVVESGVYAILSKGWSDRGTKAKDTGTSEGADGIQYPASIFAIDSIDHSWLFPRIDAACHHGGAGTTGASLRAGIPTIIKPFFGDQSFWAERVESLNVGSAVRKLTSETLASALSKATTDEKQIAKAKVVGEMIRRENGVTRAIEAIYRDLEYAKSLIKPLPEAPRRDSKSILRPLTSHTPDLNLFRSRSKSLSKASSHSPDSIELLDHRPTSVRTMSPVSERDHSRQISGGTQHSSDSSWSVVSDGIRF

SEQ ID NO: 7575 - protein, 1348 aa, Serendipita indica
MEGPRPHLQNPIMGTTIDTSPKALGLVLDARDEEDSPGVVDRIIRKSSQIKKSGHRKLNSISRKAKGPPANDEHPEERVDELEKTRRESKVSLDDAGSSYPPSRPSLNFRGEGSLRMGTQTLIQALQAIPWAEAEGGVPDKDDSDENDADKPAFTLSSSIHTIHRPVARFRRQSTAVDTASPENDSPDEEDEDDFDPDALPLGASAPRPPLHTNATARQSELPTRTIMRRSTSLATVKVQRRARLAEKLKEVFDVPEIGEVIAEMPCWLLRSVLLQGYMYLTNSHICFFAHMPSRENQVLKSGSLSKKAQRTKRWNKHWFVLKNDALTWFHSSADPYFPHGVVDLRYAIACEPHGEKGLRIRTNQRTVNLDADSIPSRDEWVKAIRKVIFQAQNHGDSVKIAIPYSAVVNVTKSKAMDFSETIEIKVVDKEDDCLDSYFFAYFHSIDLAVEQIRAALKEAKESPMIKLVQDTVKDTTSHKTSTALPLVHELDKVVSAPTPSSTSSTLSSVRDSVRDKLSTPVGKLNSLLRPGHTTPDSRPTSTMSTESSPITVTASPKSAAEKMPGDHTYPPSLVHHNVSDSSTKSSWSVPVGVPNWIKNSSKHFFTSSPEVGPGTVKVDTKDVGGIHTSAHQSTGDHGDFGFSIVDGLDSALDPATVDKFRAAFAFDERETLLAEIPGYLFRVLPVFGRVNISSNYFCFRSSQPLTKTRMMIPIRDILSTENAKAFRFGHHGLAVVIKGHEELFFEFSSIERRNACAALLDKLVDELRERQRSGLPTRPALERPESLLLETTERRSSVDTDDDTEPKPPPEGSDNIPAVMFTSVGSTFLTFKPQESLRFTCLTIGSRGDVQPYIALAKGLQADGHKVKIATHLEFKDWVEGHGIEYGYVGGDPAELMRICVENGTFTVAFLREGLAKFRGWLDDLLKTSWEACQGSDVLIESPSAMGGIHIAEALQIPYYRAFTMPWTRTRAYPHAFAVPDTKMGGSYNYLTYVMFDQVFWRAISGQINRWRKQLLGIPATTMDKQEAHKVPFLYNFSPTVVPPPLDWYEWIRVTGYWFLDDSENSLEKKWEPPAGLVDFMEKARSQKKKLVYIGFGSIVVSDPDAMTKCVIEAVRESGVYAIMSKGWSDRLSSKKHDTHAAEAVPPLPEQIYNITSVPHDWLFRQIDAACHHGGAGTTGASLRAGIPTIIKPFFGDQYFWADRVEALGIGTGVRKLTVENLTAALITATTDVKQIARADAVGKAIRSENGVANAVESIYRDLEYARSIIKRYSHETPPQEETDTEWEVPHKPGGEGSTRALSDDWNMVDEAHPENSKEAGTLSPLKRMSMGLSALTLHPKATNIST

SEQ ID NO: 7576 - protein, 1738 aa, Rhodotorula sp.
MAQVPHEASQRPGTPPAAVEPQRPSAARSHSAVVGPDADYERHTQDLKDDANSDELAGRGKGGQRFGGMGHAGYRDGQPRDEEETQPGGMTAQAGAQQPATHTSTAGTGTRIVRSPSPASSLSGSSSDSDTSDDALSSDEDSRAAAAAVATQQQQRKNRTSSGLIDTEAEMGIGGAGYGKMAVSLDEGEQRRREKERRDDDAENQSKGSKFWPGGSKSYSGGGMGPGYMRMIHALAEEDKEAERKARHERRKHRHHLRKHRHGGDHKKDGEAEGEKSPSDEDHAKFASPPEHAATTPTLARTEECELKESDPARDFAAAEQRKKARKQEKRDRRAERERDGETGMASSSLLAIHRPIEQRRRTMSDVREADAVREADEERERAPVDQAKVDEIEREQGEYEKKYPGMGSRQATSTSVASVDTVERREKLSEKLMDVFGLDEAEEVVAEYPCWLFRSILLQGYLYITAGHLCFYAYLAQKEGATIRSGSLSVRGSKTRRYHKHWLILKDNILSWYPSSADPYFPDGHIDLHYCISVEESTFHKHHFKVATADKRWHFSADSEASRNEWVKAIKKVVFRCQNEGESVKIAIPLETIVDVEKTSSLEFAEMIRVRVYDADEGYSLDEYYLSYFKDLDGALNRINAVVDAFRIHHPQGQGEKAPLPPAAAHEDVEDTTKNTTADIGEVDDYRTHPRQDEGQQQQDDHELKRSRSRSKSIGARVSSLLSGKSRNKSTPFDQKSVSDSASVKSVPASVKSVASSTSTGSAHASKRKGPAWLPPPKAPPILIPDSAKAPPTGAPTSGSVSTLRPPQTEAEPQGDDVAVEGASPLVAMAGILPASVGDSPVMESDGTCPNLAPTVENQPHGSGAAATSDETLAPRDPMHAHQAHTYPPGPAPARDSDADAAHPPARSSTLSKIFSGPGSGGRKILETVTSSSLPGRRKRKESVSDRSLTEEPRTVKEVDEFRKTFGFGDKEELLHDWPAFLFRGLPISGHAYLSDNYFCFRSAGLLATRTKMILPIRDVIGVSKHRSYRIGYSGLVIVIKGHEEVFLELSSAERRDACMNALEEQRDLVKQRKKLEKEKGDKQDDEHRELRELVDLSATKDTELSSPDMPHPQSEAIPSQPPIMFSSTTSDFVTFRPEKPLRFTCLTIGSRGDVQPYIALCKGLMAQGHHCKIASHAEYQKWVEGHGIDFAPVGGDPAELMQLMISHDFFTISFMKEAVSKFRGWLDDLLDSAWEGCQGSDVLIESPSAIAGYHIAEALQIPYYRAFTMPWSRTRAYPHAFAVPEVHMGGGYNYMTYTMFDQVFWRATSGQVNRWRKNTLKIRATNLEAMQQHKIPFLYNFSPVVVPPPLDWRENVHVTGYWWLDNPDDSKAKKWEPPQDLLDWMEEAKSKNKKVVFVGFGSIIIPDPLEMTRVVVESAEKAGVYAIVAKGWSDRQKGDEGEDSEEVKKKREESEEKHRKLMDKPFIFPVKSIPHDWLFPRIAAAVHHGGAGTTGASLRAGLPTIIKPFFGDQHFYADRVETLGIGSHITNFTVDNLTEALKKATEDEKEIERARLAGEEIRKEDGVATAIECIYRDLEYARSLVPKPSERGKDGVPLESAPEDNDDDESDDGLTSSAEEAMEEEKEAEKEKEVHDEDDSAKDGPHSESSQVSSSGVTSGTAASQLNESRTTSSDEGWDVMSRGSAVDSTSRASSTTRPEAAAESGRAADDQESQTGLLGRTLGFLGKPIKNTKST

SEQ ID NO: 7577 - protein, 409 aa, Streptomyces scabiei
MTAGSRGDVAPYTGLGHGLVRAGHEVTLVTHARFEPLVAGSGVAFHAMPVDPREELESARGQGLHRSSTGAGKLYRAAEMARSLVGRMAGDLVAAARASDVLLLAGTLAPLGHTIGLGLSIPSLGVNLQPLAPTREFAPPMTGVRSWGPVGNRAAGHAVNTAVEWIFTEEVRRLRAAYGLPYTGRAAARRTRERLGWPVFHGFSPRVVPRPGDWRSGLDVTGYWWPYDREDRLPAPLLDFLDAGPPPVFVGLGSATVPDPGRMSGEIVRALRAAGLRGVIQRGWGELRGEGEDMFTVGEVPHSLLFPRTAAVVHHAGAGTTAAGLRAGVPAVPVPVQFDEGFWAARLVALGVSPGAVPLRGFTAAALESALRRATTDPSYGRRAQALAGELRAEDGVEPVVAAVNRLAG

SEQ ID NO: 7578 - protein, 1264 aa, Lachancea nothofagi
MPKTQQSDPADANIADQTVPVSNERPSQNRWLRSLSPVGKLYHSSAGLVHLRGRNSGAEKSSLLTPSSNEPGSLDSGNKDQDPDLARPCGMAKSIVGLLTTASVYAGMGDLEQAEGMCGDEESNKREDEDEDQEEASEEYEDEVRKLDEDQLQAVEAERVGTCGSERDDGSSDSLRTASDLDSLADTVTHISKKDSLFEISVVSNNDAQSIASTDSRSRQSKIYRKLLSRFNLNEAEDEFVLKYSCWLLKDLLIQGHILLTTRHLLFFAFLPKNTGTTKMSGNLSTVAGGLGGRRIRYWAVLKDHTLSLYNSLRDLYFPLLTIDLRYASRIELTSFDEGATGDFKIHTEVKVYKLRADSKYAARSWCSALKKQLFATQNSENDSMSIKIPLANIIDVDEQIVVAQSVTLRVRVLESPQSFAVDDYFFMFLNKKDIDLKEIINDQLSRLERTQHRSQDTEDSFPFEASTTDATTGLTKRVGRGRSTSSSKKIIKRVLSPVARVHRHSFSVSMPFNPRSPQRVMGLLRSKTETQGDKSTLGTDAEQQNSLDTSLSKNSDSLSSERVEHPLQSTFDDETSSEVQDEDKGRGLKLANWAPRPIKNVGNMWGAHPVHYKYSEKDMFSDDDQYLASSQEQAIASKRFRSHFSLRNDEMLRAAYYTHLNKNIPIYGKFYLGSSVICFRSLIPGTRTKMILPIKDIENCFKERGFRFGYFGLVLVIHGHEELFFEFSLQSSRDDAEFVILKQIDGLKSEAEKSAGEVDGISQRLKEADISTEKKITEAAKLRMFEDKINAEGYDLPMMIEESPYYKTSITPKKSYKFGLLTIGSRGDVQPYIALGKGLLKEGHRVTIITHAEFGDWIKSYGLDFKEIAGNPAELMSLMVQHGSMNVGMLREASSRFRGWITKLLETSWSACQNLDILIESPSAMAGIHIAEALMIPYFRAFTMPWTRTRAYPHAFIVPDQKRGGNYNFFTHVLFENIFWKGIGGQVNKWRIETLGLGKTNLDLMQQNKVPFLYNISPAIFAPSVDFSEWVKVTGYWFLDAKDDFEPPAALIEFIARAKTTGKKLVYIGFGSIVISDPKKMTRAVVDAVLEADVFCVLNKGWSDRLEGESEGKAEEEFPSCIYSSGSVPHDWLFPQVDAAVHHGGSGTTGATLRAGLPTVIKPFFGDQFFYAGRVEDIGAGISLKKLNSKTLSRALKEVTTNSRIVKKAQQIKREISKENGVHVAISCIYSELEYARSLVMAKNKDRKSKNIASPEENTWFLV

SEQ ID NO: 7579 - protein, 1131 aa, Sugiyamaella lignohabitans
MPRNQTDSIKSGSLRKKSRKTPSFSKFWFVLRSDSFSYYTNATEMYFPAGTIDLRYAVKAEIVHHGLEKEQLKSSTFSIITETRTYTFKADSAKAAHEWVKALQKEIFRSRNEGDYVKIIIPLVNIIDLEDSPIMNIATTLKIRAIENDETYAVDEYVLAFFTKGKEVVDAIKVSMKELGVSGIAVDDSSSTDLAAKAGSLNLEEIRENRPKLLKTQTSLKVKSPMVAAAASNVASTPKSPVDSLKKTNSSVSLSKKVRNLFNDNEGSTTPGSPHLSPRIGPLKSTSSKEVIKDWTLDSPSGLESPPGESMPSRQKSRPGTPPDQLAVSAAMAALQSDRDRKSHEQEEVYPTGHTTGHIRISSSIGQIFKKEGGSGSGASTPGEDNKSYDFLSASESNQIQYESSDKKKKKSANIVHKVTDMWGGGRKHFRDPNQAGGFRDDRHLVSEEDGAESNERFRAHFSLGETDNLVATYFCHIQKAIPIYGKMYLSNEHLCFRSLLPGTNTKMILPLHVVENVTKEKGFRFGYSGLVIVVHGHEEIFFEFGSSNNRDDCEIMILREMDRSKNRSIIRQSGSDYALRSARLITYEDALRNELPPGINVPPVILEPCNDTSNDFFVGKAKDSLRFTLLTIGSRGDVQPYISLGKGLLKEGHKVKIATHAEFKPWIEKHGIEFAEVAGDPGALMKIMIEHGMFSVSFLREAAAKFRDWIDELLLTAWKACQDTDVLIESPSAMAGIHIAEALKIPYMRAFTMPWTRTRAYPHAFIVPEQKMGGSYNYLTYVMFDNVFWKGISGQVNRWRKKTLHLPRTNLDLLQQTQVPFMYNVSPSVLVPPVDFPSWIRVTGYWFLDEGGEDYVPDKSLVDFIAKARKDDAKLVYIGFGSIVVSNPKELTKAVVASVQKAGVRCILSKGWSDRLGKGDASVPEVELPPEIYQIKSAPHDWLFPQVDAAVHHGGSGTTGASLRAGLPTIIKPFFGDQFFYAGRVEDLGAGVHLRKLTVNQFSKALWEVTHNERIISKAADIGKRIREENGVDTAIQVIYQELEYARSLIKDGNVPVGRKIPTLMDVAGLPVKLVQRATAPLPSLPICHDDSDQEHDEERDKKSNSSQEDDSTHTDGSWTVVDTESKEQE

SEQ ID NO: 7580 - protein, 1324 aa, Parastagonospora nodorum
MASQDRGRDRSSRRLTKKRKDIGRDTRGLSLDIPERFKDGDDAQEDVTAPKRSDAMSMNQSIFSIIARAGGQSQVDLGTMQEVDSGDSDDDGKGKTLHDRLDGAARLSRLRTANDFRPPQEDSRAEKIGSGKHRRALSENKLLRSLPKLKISSRKDVRSDGQHTDQMSSSQFLPPRPSTETPSETHKRGDALKGKARATTGDEIHVEKQRKSERRGGQGSSVGLAQSRGPVSLATRIQQIFEFEHAEEVISEYPCWLLQSILLQGYMYITQKHICFYAYIPKKHHDVSKTGYLYKRGRSKYNRYWFILRGDVLSYYTNPAELYFPRNRINLQYAISAEVVENKKKGEYETIFTVTTDERTYQFKADSAASAKEWVKSIQKVIFRTHNEGNSVKISMPIRNVIEIEESSILDFADTVKVRVVDNGETFAIDEYFFSFFNRGQDALNVLRIMINDNEHHQVSTENQVNPTPITAPLKTSNRHSLVVSPIVPDDTPRIKENVRATLSPLPNPNVGRSSISDISARSSTDVPRKSWDTNTSLLPASTEAEEDTDPSQTLPRLSNSSSALQEIASYPLQKASGIAGFLRMRSKEMGSLLATESMGYYEKVSGMLAGGRKHYNTADGLEPHDQIHGIEDDDDAAKAADNFREHFAFPESEILQSSFFASLQRMLPNYGKIYISGRYFCFRSLMPTSKTKIILPMKDIENVNKEKGFRMGYHGLAIVIRGHEELFFEFSKAEYRDECAITVLRILENTKYIEEASSSSGVDSDDEAAKAEHDLLQQAREQSDTHEQIDVSEIARAADHDRIPLIFDDPLASFVDFKPPEPLTIVCLTIGSRGDVQPYISLCKELLKEGHKARIATHAEFEPWVRKHGIDFAPVDGDPAELMRICVEHGMFTYGFIKEANSKFRGWLDDVCSSSWRACQGADVLIESPSTMAGIHVAEALEIPYFRAFTMPWSRTRAYPHAFSVLENKMGGGYNNMTYQLFDKLFWTAISAQVNKWRRRELGLQNTSQSKMQANLRPFLYNFSPHVVPPPLDWPDWIRVTGYWFLDEGDTYQPPADLAAFITQARKDEKKLVYVGFGSIVIDDPAALTKTVVDSVLKADVRCVLSKGWSDRLATKDASKPEIPLPPEIFQIQAAPHDWLFKQMDAAVHHGGSGTTGASLRAGIPTIIKPFFGDQFFFAQRVEDMGVGIWLKKVNTSVFSRALWEATNSQRMIIKAKVLGQKIRKDNGPQVAIQTIYRELDRARTLVKKHVKQDDEQTDEFEEDWTMIEEGQDVDVSAHHFEAQSPLVGMNQDAPRTGGGSLVLGSMVMKGAQKRNSESAYRD

SEQ ID NO: 7581 - protein, 1159 aa, Schizopora paradoxa
MTRSASLATVRLKRRAKLADKLKEVFGLPDLHEVLAELPCWLLRSVLLQGYMYLTNSHLCFFAHLPSREDQVLKSGSLNKKTQRTKRWVKHWFVLKNDVLSWYQSSSDPYFPHGVVDLRYAISCEPMQEKGFRIKTNQKVVQLMADSVPSREEWVKAIRKVIFKAQNMGDSVKIAIPYSVVMDVDKSSAMDFSETIEVKVLDNEDKVGLDSYFFAYFQNISAALDQIREAVKAYKPIAVSPSALEHVQDTTGVKLVSHPNLAMERTPSEPTRSSGYGLRLPSLFRPFSSENPMPPSHQVTQSQWQSSGEFTHVLRPSSTIVASPSTITPNATPRLSQASTVESTSRQSRVLTESVLEGVKISDFHTYPPSPSPSTELAPLPTRDSGSGSSWGVPAWLKGSTRRVFSVSSSSSGGTVGRRGVSEVVSAGMGDVSTELGFSVLETHEAAEPEVVEKFRTTFAFDEKETLLGYFPGYLFRLLPTFGKLYISNNFFCFKSSGPLATRTRMVLPIRDILTLEKSKAYRFGHHGLVVIIKGHEELFFEFSSSDKQSAFYELLNRQMEDSRRRALSADTQALIARKQDHVILEELEPASLFGEENPKPPPESLADSLPAVMFTSTSSTFLTFKPQQPLHFTCLTIGTRGDVQPYIALAKGLMADGHKVRIATHGEFKEWIESHGIEFGYVGGDPSELMRICVENGMFTVSFLREGVQKFRGWIDDLLKTSWEACQGTDVLIESPSAMGGIHIAEAMRIPYYRAFTMTWTRTRAYPHAFAVPEHKMGGGYNYMSYVMFDQVFWRATAGQINRWRRNTLKLQSTNLDKMEPHKVPFLYNFSPTVVPPPLDWPEWIRVTGYWFLDDADVTAKKWEPPQDLIEFIDKAHSSGKKIVYVGFGSIVVSDPDAMTRCVVEAIEKSGVHAILSKGWSDRLQVKKGVDISQPEIPLPPSIYPLKSVPHDWLFKRIEAACHHGGAGTTGASLRAGIPTIIKPFFGDQYFWGDRVEALGIGSCVRKLTVDGLADAFIAATTDEKQIEKARHIGEQIRSENGVATAIESIYRDLEYARTLIKAARAASGSDDDDNVLVENPQALASSQSTPDRSSRGSWHEASQAASDWSIVSDSEDKKPSRKNSTKERDSSPSKRNSLAAAVLSVLPDALAPSSLKK

SEQ ID NO: 7582 - protein, 1269 aa, Lachancea meyersii
MAKKKQSGPESAVRAAQEGRARGGTGSQLRWMRSLSPVGKLYRSSASLIHFPGKVIYSGNVIPMAGDSEENMSLDSGGKDTEPDLARPCGMAKSIVGLLTTASVYAGMGDMEQAEEIFEDEEDGEDEEDGEDEEDGEDEEDGEDNEEDKAEVTNAAHEEQNEPEFVPPEHADESSDSLQTVSDLNSLADTITHVSKKDTLFEISVVPNHDATSIQSTSSGSRQLKIYRKLLSRFNLNEADDEFVLKQSCWLLKDLLIQGHIVLTSRHLLFFAFLPKCTGTAKMSGTLSTYSGGLRGRWTRYWAVLKDHTLSLYNSRKDLYFPLLTIDLRYASRIELDKRGNESTSFFKIHTETKNYRFSADSHFASRSWSSALKKQLFTTRNSENDSMSVKIPLANIIDVDEQMLVAQSVTLRIRVLESPTSFAVDDYFFMFLGKNEMNLKQIINEQLSKMDKPLIKTANTSHGPAPNLDSQAMEVNSPEKAVRGRSDSNSRKIIRRVLSPVSRVRRPSFSVHVPFNPKSPQRALRLLKTRDDSVGNIRISNGDTEGEINRDSLEETAELLSSSGVPITPVATSDSEESAELSDDARAGTSKFASWTPQPIKNMGSMWGAHPVHYRNEDADVFPDDDQYLASAKEQAVASKRFRSHFSLKQNENLRAAYYTHLNKNIPVYGKLYIGSSVICFRSLIPGTKTKMILPIEDVENCFKERGFRFGYFGLVLVIHGHEELFFEFSLQSSRDDAEFVTLKQLDSIKLDAGSSLSMADGLSQKLRNADISSEQQSTEAGKLRLFEDKINAEGYDLPMMVEESPYYKTSITPKKSYKFGLLTIGSRGDVQPYIALGKGLLKEGHRVTIITHLEFADWVRSHGIKFREIAGNPAELMSLMVQHGSMNVGLLREASSRFRDWITELFETSWHACQNLDILIESPSAMAGIHIAEALQIPYFRAFTMPWTRTRAYPHAFIVPDQKRGGNYNFFTHVLFENIFWKGIGGQVNKWRIETLGLKKTNLMMMQQNKVPFLYNISPAIFPPSVDFSEWIKVTGYWFLDGKDDYNPPPALTEFIARAKANGKKLVYIGFGSIVINNPKKMTKAIVEAVLDAHVFCILNKGWSNRLEEETETDPVEEEFPDCIYNSGSVPHDWLFPHIDAAVHHGGSGTTGATLRAGLPTVVKPFFGDQFFYASRVEDIGAGINLKKLNSKTLSRALKEVTTNSRILQKAQQIKAEISKEDGVRTAISCIYSELEYAKSLVAAKSQDKRKNIKDVGSPEENSWFLV

SEQ ID NO: 7583 - protein, 1515 aa, Sodiomyces alkalinus
MDLPDRLKGGDNSDEEEDLVPAQGPNMFTHMNQSIFGLIAAAGSRVNFHDRFEGQSSDEEDDADDDPSRLTATPRHHSDRSDPLGRRDSRHRSRPDDTQPSASKSAILDALKPHRRSSISRSKQKLARTLAALPRLSEKIGGLSRRSSQRESPSDDMNESFHSDAQISSSSATSNRGDLAPRLAPVMSRMLEARADATLRPSFDRDRRPTDDELTSAFDMGAEPGPSPLAVRLAQIFEFSEPEEVIEEYPCWLLQTVLLQGYMYITARHVCFYAYLPKKANEVVKSGYLSKSGKRNPTYNRYWFRLKGDVLAYYRESSNLYFPSGQVDLRYGISASITDKDKEGLHFTVTTSYRTYYFRADSAPSAKEWVQSLQRVIFRSHNDGDSVKISMPIDNIIDIEDTQMLQFADTCKIRVIDNDETFAIDEYFFSFFSFGKEAISVLRILFEDASARQKKDGTKIEALDDGTPGATASGQPSGQPSDQSAGRPSLSMTKRRSVGPGQIRTARLPEPVKATLSPMASASPNATSPRPSQDARRGSFDALRGSLDLLKGLGRRGSADMSSVTRDRSPRTFSGSRSVSRHRFEDMSASASAPMPSSPIPDKNESSDSFARSSMEDPSYSALGVSSVEDPSASQILQRSDVFQSPTIGRHDSASRQDRQRPPLAAQHRSASTPAPPPALATHAGQHAEASGAPTLQTITQIGTFPLQRVGAFAEYLNRSSRRMSSLIAAESMGYVEKVSGMWKGGRKHYDAPTEMREEDEDLYEDGEGNVQQSTERFRAHFALPETEKLQATYFGFLFRVLPLYGKLYLSDRSLCYRSLLPGTRTKLILPLKDVENVHKEKGFRFGYSGLCVVIRGHEEIFFEFSQQDARDDCFGALLKSIERFRFLDSSGTISREDTQDAEFALAERQALKEARQEEFPDHEIELPRQTTSDCRDAPTILYDDPNDSLLRYKPPRPLRITCLTIGSRGDVQPYIALAKGLMAEGHHVRIATHAEFRGWVEGHGIEFAEVDGDPAELMRLCIENGVFTWSFLREANSMFRGWLDSLLESAWRACQGSDLLIESPSVMAGIHIAEALGIPYVRAFTMPWTRTRAYPHAFVMGEYRMGGAYNYMTYVMFDNIFWKATAGQINRWRNETLKLRSTSLEKMQPNKVPFLYNFSPSVVAPPLDYSDWIRVTGYWFLDEGADYKPPQDLADFIAKARADGKKLVYVGFGSIIVNDVAKMTQEVIDAVLKADVRCVLSKGWSDRLAKNERQPQPQPQDGHDNGDRSTDEDEKDPKSGGAAAARREEPVIPPEIFVIKSAPHDWLFRQMDAAAHHGGSGTTGASLRAGIPTIVRPFFGDQFFFGSRVEDLGVGIFLKKWGAMTFGRALWEATHNERMIVKARVLGEQIRKENGVETAIQFIYRDLEYAHSIIQRKAGKNKTEGEKKEAGDGEGGLGGGSGGDLSEAEEEESWTFIGADEPDPEMVTKRLSEMPSTAGGGGVPGIGALALGGRPKTLGRRVLSGSRGGGCAGA

SEQ ID NO: 7584 - protein, 1457 aa, Exophiala sideris
MASHDTPSKRSGSRKLQKPNPRLSRLPSSHMPARLSLGADAQDDVTAPSRGRNAPAQYMNQSIFSMIAAAGSRTDFNARFDESSDSEEEIAEEKSTELKGIAAPVGPRLPDADAGQSVAIHDRDTVVDKKSKRLSGHRLVQSLPRLSARAFKSKGKEPAAPTSPSPESDESSESTSNPRDAPVLSRLITAEAEFKENEEALALTTSPEAQAPRARGDSTPQTLLATRLMEIFGFEQPEKVVAEYPCWLLQSVLLQGYLYITKQHICFYAYLPKKSHTVGKTGYLSKKGRTTSKFKRYWFSLNGDVLSYYSDPANLYFPSGNIDLRYGISAAFLTDKHKSKECKDFSLTIDHRTYHLRADTGSSAREWVQALQKTIFRSHNDGDSVKISLPVENIIDFEESPVVEFAETVKIRVIESEDSYAIDEYFFTFFSFGQDALQVLGSLLAEASGRRTSEDLLSPARKDATLRSPRTRPAISRQSSDFAPGSPRAQSSPPLKDSVRATLLPFSPEEGGKLSPRMSGDFHRGNSPSRLSVESPHFYGRASFDRGRRSGSTSRLEVNTSRRQSPLTRPMESEDFYFQSTDKETDSSNAPLSPRAEAQMSASQILTRSDVFHPPAVQRMETLASMSPEPTRKSSEVPTIPSTSPPKEVTSPIPIREAAETFGRSPREGRTGVHAEGMLRTGTSPTLQDLVKAGSYPLQRAGAFADFLKSRSVSMKKLLATESMSYLEKVSGMWAGDRKHYGENEGVVPDDKGIDPEDEEANVGHGDRFRAHFALPPSERLQATYFGFLHRVLPLYGKIYVSNRKFCFRSLLPGTRTKLVLPLKDIENVDKEKGFRFGYHGLVLVIRGHEELFFEFSSSEHRDDCTVTLLHSLETVRYMTESGILAKQDQDEAETAKEEHRLLQEARRDSSGDHQLVLPDTAEAVYSHQEHASVLFDDPRASIINFKPLASLRITCLTIGSRGDVQPYIALCKGLLAEGHKPRIATHAEFGPWVEKHGIEFRPVEGDPAELMRICVENGMFTYSFLREASAKFRSWIDELLTSAWQACQDSDLLIESPSAMAGIHIAEALKIPYFRAFTMPWTRTRAYPHAFAVPEHKIGGAYNYYSYVMFDNVFWKAISGQVNRWRKKELGLRSTNLDKMQPNKVPFLYNFSPHVVVPPLDYSDWVRVTGYWFLNEAQDWTPPPELTTFIQNARDDGKKLVYIGFGSIVVSDPAALTKTVVDSVVKAGVRCILSKGWSDRLGDPAALKTEVPLPADILQIKSAPHDWLFTQIDAAVHHGGAGTTGASLRAGVPTVIKPFFGDQFFFGSRVEDLGVGICLKKVNVSLFSRALWEATHSERMIVKARLLGEHIRQENGVQTAIQAIYRDFEYAKSLVKARAAIESVPANATAPVDEGDIEESWTFIGDESDPDLRKQIQEWDLPVRGRGPRVSIDRAGLRSMQGVEPVRKSSSVKRRY

SEQ ID NO: 7585 - protein, 1489 aa, Dactylellina haptotyla
MSSEVEDRPTRSNRVDLPQRARPRSHSPALPDRFKIASDEDLKDVSFSARGTNFSMHQSVFQMIQAASSKVDFHARFDSDIDEAEDEDEDSDEEAKRKRAMKNFVKDGLQSAPKESTQASTTDPEKIDLSASRQLSESRFHPKNIIKSIQQKRHDKKTRHAPSSGVSTSDDISSSTELTSSQGSMVSSTSQSNPTDIPSLEQSTIAAADSAIHAAQESDDVLFPEFSISSTALAEKVQKIFHLAELEEVQSEYPCWLLKTVLLQGYLYITDRHICFFAYMPKKQDSILKSGHFYKRGRKNPRYGRYWFTLKGDVLSYYSDASELYFPSGNIDLRYAIHAYADEGSKDHTFTLVTNSRKYEFKADSATSAIEWTKALEKVIFRIHNDGDSVKVVIPIENVLEIEKSPVIEFADTFKLKVVADDETYAIDEYYFSFFTFGAEAFELIRLLVEDTTAQKIPKDLLTQGTAGTAPTSKRMSLGCSPAREMSPASPTRLSLRNSLVIGMPAWPAATGPTRSGDGPVTPLLKEAVRDTLLPVPASPVVGSPRTSGEYSRRSVDVANRRSTDVSRKSLDASRKSMDGEYRSSSLASVLRRKTKSQKQSPSVSAAGSPSREMTSSSFVKSLQSEPSSLTESSDVMPISSESEGELAASQFLSRSDVFQQSIAFADPAGIDRGRSPTLKGKAGTIAPVGAPPLHIHPPSRTGTDLSVPTTIESVKKTESSPGELERPSLEGRTSSDKKYGIPGPSLGDVYRVGSYPIRSAQGIADWMKRRSKHVATGSIGYFGKVTDMWTGGRKHYDDKGSTPTDTATGDADADDEDEGAATPSERFRQRFALSESENLVAVYFGYLSRVLPLYGKIYLGDQHFCFRSMVPGTKTRMILPLRDIENVDKERGFRFSYHGLVVTIRGHEELFFEFAGLENRDDCGSTLSKVIDNVRHMRESQLITPEQKINAEIAKREHELLQEARLEAGHLEHEMKLPQTTKEVASGHAMDVPPIVFDDPHTSIVHFKPQESLRFTCLTIGSRGDVQPYIALCKGLIKDGHKARIATHIEFKGWVESHGIEFREVAGDPAELMRVCVENGMFTLSFLKEASSKFRSWIDELLDSAWIACQDSDVLIESPSAMAGIHIAESMRIPYFRAFTMPWTRTRAYPHAFAVPDHKMGGAYNYFSYIMFDNVFWKAIAGQVNRWRKKDLNLKSTSLDKMQPNKVPFLYNFSPSVVIPPLDFSDWIRVTGYWFLDESQQNFEPPPEMLDFMRKAREDGKPIVYIGFGSIVVSDPQALTQTVVDSVIKADVRCLLSKGWSDRLGKKDASAPEIPLPDCILPIKATPHDWLFKHIDAAVHHGGAGTTGASLRAGLPTVINPFFGDQFFFGGRVEDLGVGVCLKKLNVKTLSEAMWLATNSTRMITKARVLGEQIRSENGVDTAIQAIYRDMEYAKSLIKNPQLETSDSAEESWTFVSREESDAEIARRNSMKDTASEGSNKTTGASTP

SEQ ID NO: 7586 - protein, 667 aa, Tilletiaria anomala
MTAQSSLYRVLPTKGLLFISDRHICFRSSGLATRTMGRTLMMLPIGDVITVARHRAFQPGQHGLIVVVRGHEEVFLEFSSVDLRNECCERLEQMLEEALMRPTADISIGKQDDLILKDLSDKLEATSISTSLPSSSSSDADTQDWESGSVSASMFKSQSSDFLSFLPKQPLHITMLSIGSRGDVQPYIALAKALMADGHRVRIATHDEFSAWIEGHNIEFSAVGGDPAELMRICEQNGTFTVGFVREGLLKFRGWLDDLLLSSWRACHGTDVIIESPSAIAGIHVAEAMQIPYFRAFTMPWTRTRAYPHAFAVPHSKAGGSYNYISYVIFDQVFWRAASRQINRWRQETLRLKSTTYDLLEQHKVPFLYNFSPNLVPKPLDWYEWIHVTGFWFLDNPGETSGRSWAAPDDLVAFINTTKAQKRKLVYIGWGSIVVSNAAAMDECVGEAVRKSGVCAIVSRGWSDRLSENKGTPSEAFSSPDIFRVDSVPHDWLFPQLDAACHHGGAGTLGASLRAGLPTIIKPYFGDQFFWGQQVESLGVGTCVKECTAENLAAALRKATQDVRQIERARQLGERIRSENGVQAAVTAFYRELEYARSLIKTDSRLHTTNSEVQASNTVDGASPSQPHAEELHERSSRAIDAINTPSNRPRSTRSSSADSNWSILSP

SEQ ID NO: 7587 - protein, 1443 aa, Fusarium graminearum
MATQADDAAASQANIEDGDLKEHVHDELDKIQQQRSTATVFPEPLRESDSEDSDDEDNGPAQAPPMFMNMNQSIYGLIAQASNRVDFNDRFDGMSSDEEGESSQNTRTESIARTSILQPAGKGKDKVHRRRKLSEHKLLRSLPALPKLRSRHKSQHSTLPAPEEVADEADDEHGDGGLLPAPALTLTRQDTQDRLAPVMSRMLEAKADLSIRPSFDLDRLSSDVSRSSDSDEVSALSRKLKEIFEFDEYEQVIEEYPCWLLQSVLLQGYMYITSKHICFYAYLPKKTHEAVKSGYLSKSGKRNPSYARFWFRLKGDVLTYYKTATDVYFPHGQIDLRYGISASIVDTDKEALHFVVETRHRTYKFKADSAPSAKEWVKSLQRVIFRSHNDGDSVKISLPIKNVMDIEDTQMISFADTCKIRVIDNDETYAIDEYFFSFFSFGKEAINVLKILIEDSSGARSAEQVITGDDHDSSQPSSGHASKAASKRAPSKLSTGKLPDTVKATLAPMSPLSPRSPSQLSPRASMDAPRSSFDGFRRFGKKSLDVTSSIGDHSPRRSFSGRRSTSHQHRQGTTTPKQAHDSEDSFLQSSIENPSISTLSPSSYDEPSASQILQGSDVFHSPMMRRSASTSRKRDRSGKRTPRSSSAHGDRHHGIPHAATTGAIHKMGDEQADSQRPATPTLNSITKIGAYPLQRANAFAEYLSRTSQRMGSMFATESLGYVEKVHGMWKGEHRHYDEPQELRTDDDGEDIDSEADDKMQTTIDRFRAHFALPESEKLVATYFGAIFKVLPLYGKFYISDRSFCFRSLYPGTRTKLILPLKDIENVHKEKGFRYGYYGLTVVIRGHEELFFEFRKPGLRDDCAVTLHQLMETNRFLEQSGILDQEEQDDEEAAAAMAERDELQEARQDEFVDHELTLPRTTSGVSNAPTILFDNPNSSGLAFKPQKSMKITCLTIGSRGDIQPYIALCKGLLAEGHKPRIATHGEFQEWVESHGIEFARVEGDPGELMRLCIENGTFTWAFLREANSTFRGWLDDLLDSAYTACEGSELLIESPSAMAGIHIAEKLEIPYFRAFTMPWTRTRAYPHAFIMPEHKMGGAFNYMTYVMFDNIFWKATAYQVNRWRNKTLGLPSTSLEKMQPNKVPFLYNFSPSVVAPPLDFSDWIRVTGYWFLNEGGGDWKPPQELQDFIAKARADGKKIVYVGFGSIIVKDPAKMTQEVIDAVLKADVRCILSKGWSDRISPKDDPSKPPPDEPVIPAEIHVITSAPHDWLFSQIDAAAHHGGSGTTGASLRAGIPTIIRPFFGDQFFFSTRVEDLGVGVCVRKWGTNSFGRALWEVTRNERMIVKARVLGEQIRSESGVDNAIQCIYRDLEYAKSLIKRRAGKNNAEHGLAEDDDDTEESWTFVGRDEPDPDAVTKKLSDGLAGLGAAGDRPPPLGSQAPTVA

SEQ ID NO: 7588 - protein, 1487 aa, Arthrobotrys oligospora
MSSEVEDRPTRLDRVDLPRRARPRSHSPALPERFKIATEDDLKDVTLSARGGNFSMHQSVFQMIQAAGSKADFHRFDSDIDEEAEEEDSGDEETKQRKMAKNFVVKEGLESANKERTQAVTDPEKHDTAASKRLSESKFLPRNIIKSIQQKRHDKKSKHTSSSATSTTPSASEDISSSTELPSSEGSSILPSVSRSPAGEVPSLAQSTVTATNSAMEATQEVGGEDVLFPEFSISPTALSEKVKVIFNLPELEEVKSEYPCWLLKTVLLQGYIYLTDRHICFFAYMPKHQDAVLKSGHFYKRGRKNPRYGRYWFTLKGDVLSYYADASDLYFPSGNIDLRYAIHAYVDEGSKDHSFALVTNSRKYEFKADSATSAAEWTKALEKVIFRIHNDGDSVKVVIPIENVLEIEKSPVIEFAETFKLKVVADDESYAIDEYFFSFFSFGAEAFELIRLLVEDTTAQKIPEHLLTRGNSKRASLGCSPVREMAPSSPTGQSIRHSLVMGMPAWPAATVHLKSLDGPVAPLLREAVRDTLLPVPTSPVVGSPRTSGEYARRSFDVTNRRSIDFSRKSMDNNEARSSSIASVFRRKTKGRKASPPRSAAASPSREMSSSSFVKSMQSEPSSLAESSDAIPMSSESEGELAASQFLSRSDVFQQSYPAGTDPSGINRGRSPTLKDNAGTIDPLPAPPLNIHPPSRAATDLGVPVNVPEGSVKKIESSPGELGRPSLEERTSSDKRFSLSSPSLGDVYRVGSYPIRSAQGIADWMKRRSKGVASGGMGYFGKVSDMWTGGRKHYDDQGPIPNADAAGDVDADDEDEGAATPSERFRQRFALPESENLIAVYFGYLSRVLPLYGKIYLGDQHFCFRSIVPGTRTRMILPLRDIENVDKEKGFRFSYHGLVVTIRGHEELFFEFAGLENRDDCGSTLAKAIDNSRQMRESQLITAEQKANAEIAKKEHDMLQEARLEAGHLEHEMKLPHTTNEVAQGHGMDVPPIVFDDPHTSIIHFKPSEPLRFTCLTIGSRGDVQPYIALCKGLMKEGHKARIATHAEFKDWVESHGIEFREVAGDPAELMRICVENGMFTISFLKEAAGKFRTWIDDLLSSAWAACQDSDVLIESPSAMAGIHVAEAMKIPYFRAFTMPWTRTRAYPHAFAVPDHKMGGAYNYFSYIMFDNVFWKAIASQVNRWRKKELHLKSTSLDKMQPNKVPFLYNFSPHVVIPPLDFSDWIRVTGYWFLDESQSNFEPSPEMIEFMRKAREDGKPIVYIGFGSIVVADPQALTQTVVDAVVKAEVRCLLSKGWSDRLGRKDASTPEIPLPDCILPIKATPHDWLFKHIDAAVHHGGAGTTGASLRAGLPTVISPFFGDQFFFGGRVEDLGVGVCLKKLNVKTLAEAMWLATNSNRMITKARVLGEQIRSEDGVQTAIQAIYRDMEYAKSLIKNPQQEASDSAEESWTFVNRDEDDADIARRNSIKDTNSDDSSSKITGASTP

SEQ ID NO: 7589 - protein, 1217 aa, Coprinopsis cinerea
MPSVTDDSPFITPPSPPLRPSSTPFRGDGSMRAGTQTLIQALQALPWMMNEVDEDSAVNDVSQSEPESSDDDRPGFKRLSSSIHAIYRPLARSRRMSIPIPRRRKDRNTSQPLEEETSSALSSESEDDAEADFEEQPPQPPHSRPTPLQHQSLPPLTITDKSVAQFRPLYDRTAEKLREIFELEGIQEKCHAGYYDLSGYMYLTNDYLCFFAHMPVREDQVLKSGSLSKKAQRTKRWIKHWFILKNDALSWYQSSSDPYFPHGILDLRYAISCEAIGEREFRIRTTQKSVTLSADSVPSRDEWVKSVKKVIFKAQNSGDNVKIAIPYSVVLDVELSTAMDFSETIEVKVVDKDDQYSLDSYFFAYFHDMPAALEQIRDAIRTHRAIPEHSQEKTVLDTTVTRSPPPSALERPSTIASDSVVPKSTSGFRLSSILKPFSDTISLTRASTASESESQCSNEEFTYISQRGPSSFVPVTTSPKSITPQEQLASQPGPSSQSLPNPDHTYPPSTFSSSIHPDMSSLTRESTSLWNVGVPSWLKPTRRVFGSFASSESTPTSYGSMAVKEVYSSPAPSAQGSSLSRMTGGDLAYSVLEAPAASIDQDVVDKFRTAFAYDEKETLLGYFPGYIFRLLPVFGRLYVSTNFFCFKSSGPLAVRTRMTLPIRDIVATEKTKATRFGHHGLIIIVKGHEELFFEFGAADKRDAFVRLLEKQMDDVRARLAVGETLEPSSEKREALALEAFDSKTSASSDSDPAPPPDNMSDSLPAVMFTSASSTFLTFKPPKPLHFTFLTIGSRGDVQPYIALAKGLIADGHKVRIATHGEFQEWIESYGIEYGCVGGDPAELMRICVENGMFTVSFLKETLQKFRGWLDDLLQTSWEACQGTDILIESPSAMGGYHIAEALGIPYFRAFTMTWSRTRAYPHAFAVPERKMGGSYNYMSYVMFDQVFWRATAGQINRWRRHTLGLGATSLDRMEPHKIPFLYNFSPTVVPPPLDWPEWIRITGYWFLDDADVGSKKWTPPDSLVEFIDNAHQSGKKVVYIGFGSIVVSDPRSMTKCVIDAVVQSGVHAILSKGWSDRLHVKLADASEPEEPLPPQIYPITSAPHDWLFARIDAACHHGGAGTTGASLRAGVPTIIHPFFGDQFFWADRVEALGVGTGVRKLTVSALKDALVSATTDQKQIDRAKLVGEQIRRVHFLLDPGPFSSLTLEHRRTAWLLP

SEQ ID NO: 7590 - protein, 611 aa, Aspergillus niger
MPHQDGPTADDWPDEHLTEQTTNSTGHGRTPRRAHYHERGLNTGVRVMDDGRLDIKIRERKPWVSKIIKHLQQQPEPLHEERKPSVCFIEDGKPPCALKLNIVIQVVGSRGDVQPFIALGKVLKSHGHRVRLATHLAFRESIEHEGLEFFNIGGDPAELMAFMVRNPGLMPHMSTLRSGAIPRRRREMKAIFSGCWRSCYETGDGTGLHHIPEDPWSETADYRTMPFVANAIIANPPSFVHLSCAEKLGIPLNMMFTMPWSATQSFPHPLATIRTKNTKPSAANFASYAIVEILMWEGLGDLINSFRKRELGLDPLDAIRAPSIAHRLRIPYTYLWSPALLPKPGDWGDNIDIAGFSFLSSGSDYTPPDDLANFIKSGPPPIYVGFGSIVVDNPGSLTKIVFQAIRESGQRAIVSKGWGNLGADEDDIPENIFMISKSPHDWLFQHVSCVIHHGGAGTTAAGLVLGRPTIIIPFFGDQPFWGSIVARAGAGPLPIPHKQLTVEKLTNAIKQALEPETLEKAKEIGKEMRKERGVQNAAASFYQHLDVQTMRCSICPDRPAVWWVKHSHIKLSTFAAAVLVETGLISPRNVVLYVLCSLYLADGVYMANWWF

SEQ ID NO: 7591 - protein, 1191 aa, Wallemia mellicola
MRMGTQSLIQVIQAFAHHADDDSNDDDEDAQEDTQDHRVFDMYSSLNTVHNKPQTHLHESMSTSMSGTPHESQDEDEEAGSDRSAHSDDSELTRMRSQSLKKKSTQRRRNLSKKLSEIFDLDSQEDIKAEYRCSLLGSSYRPLLEGFLYSTNSFLCFFAHVPTLERNNVVKTGPIGKRTLRTRRVIRYWLALKDDVLSWFGSAIDPYFPVGNVALRYAIRCVTVKNSDREFTIFTSERKFTFLADSKTGRNEWVKVIRKGMFRSQNESGSFKLVIPYDHVINVERSSNLEFADSISVSFINNEDGADYYYFDHFRDSQSACNTLSEILETHRHDVHRILSNENLVMSPTKMKDEFIDGSEVTARPSSSGHIGNHTYPPSNTKNSRSRSSSLTAEIPSWIKSGSIKLGKVVYSAPRMIPHPHLSTILPKLPSIPFLNNNNSNQGRQQPLPNPALTNQLMRTNSRVYEHYEEPTNSRSNDNNRSRSNSGVAESDDEFEEVGSDFSVLEHSAGMEDILKVEEEVQRKFNDYFALPGEKILGHFNCALFRVYPTPGKVYITNNYLCFRSFQIWSRTKMILPLNDLQAVQPHKPLRFSFHGLIMIIHRHEELFLEFTTSNRRDACEKLLNTQLDKIFRSASIQQTQSSKGLQEAQIIEDLSLSYRHPSLTAPVLGEEGVSPSTSVVSFKPKNPLRITCLTIGSRGDVQPYIALCKGLIKEGHHCRIATHLEYKDWIENYGIEHREVGGDPAELMQICVEHGTFTLSFLREGLFKFRSWLDDLLKCSWEACQGSDLLIESPSAMAGIHIAEALQIPYFRAFTMTWTRTRAYPHAFAVPESRMGGSYNWMTYTLFDQVFWRAISGQVNRWRRSTLGLTGTNLQRLAQHKVPFLYCISPTLVPKPLDWNEWIHVTGYWFLDSITPENSENSVNDNNGKWDAPAGLLEFIAQGRSLNKKIVYIGFGSIVVSDPDEMTKCVVEAISQADVYAVLSKGWSDRMHTGKKEEKLLFPPSIFSIDTIDHAKLFPMIDAAVHHGGSGTTGASLRAGLPTVIKPFFGDQFFNADRVEATGVGSSVRKLTVETLSKALKTATTDEKQIANAKTVGEKIRNENGVANAIECLYRYMDYASTVITTRAHENLQHDDGIDAQDIEDDDDWSLPSETFSEDEAQRSMGVLSLATNIGKRSLGVGKDLITKKL

SEQ ID NO: 7592 - protein, 1187 aa, Brettanomyces naardenensis
MTSRSQSYDSSDGDEYFTTDADKQSIDPSIHVPSIHIGSTQDSSSRLSRKDSAHQRSSVLSKLAFSPGRLLASPTRILQSLSPGRKKDPDVDTSIEASIDGISRSFAGFLTTASIYAGFQDIEEANEEPNEDEQPIPNPTALSSPTISSPPTAPSSKSRFEISFVERKPTLSDQRAAELSLRLRKTFQIPEDSEFIADYSCWLMGDVLLQGHLYITNECILFSAFLPKKGRGKIVQQGALSVKSTRFHRKWAILRESTLSIYSSSTELYFPDLVIDLRSALRAEIHHSGSEEGSVWLKVVTSKKTYWFLADSLSSARSWVSTIKRQIFQSRNHGDQAIVKIPLQSILDLELTTVLGETKNLRIKVIENPDSYAIDDYFVLFFSQGEKASEDIRRVIKDAGIELGDGETDEECSELMKSKAKLLKESEIAVETTNYLIGEEGAKVLWDSKEEVEEEEEEEAVAVPSRSSRYSPWGHVQAAASSLSSLALPFSSPTVSHFGPETVGDPFYVADSSIRKQKQESFLQFFSLPDELLVASYHAYILRGLPSYGRLYIGTHHLCFRSTLPGSGTLMILPFADIENAAKEQGFRFGYSGLVVVIHGHEELFFEFSNQNARDDCECQLLRQLDVLEAEVSPSSRSGSQTLSSPPDSVTLASARIRLVESKLNDSIGADVPIIMEDHPLQKTEVHPSRPYRFTLLTIGSRGDVQPYIALGKALMKEGHKVKIVTHAEFGPWIKSHGLEFDVIAGDPSELMALMVSHPTISYSFVRDARSKFSSWIDELLESSWKACQGTDVLIESPSSFAGIHIAEALQIPYFRAFTMPWSRTRAYPNAFLVPDQKLGGSYNYMTHVAVENGYWRGVSNQVNRWREQTLHISRTSLAAMRQSSIPFLYNISPVVFPPSVDFPEWVKVTGYWFLNEGGEEYKPDSKLVEFIRKAREDGKKLVYVGFGSIVVDKPKELSRAVANAVLEADVRLVLNKGWSERGSTEEATDEVTAEEEVEGGNPEHDDANTPEFPPEVFSSGSVPHDWLFPLVDAAVHHGGSGTTGASLKFGLPTVIKPFFGDQKFYASRVEDLGCGVVLKELNCHSLAVALKEVTTNKRIQEKAKLIGKKIRAENGVQNAINAIYSEMEYARSLSAGKYKAMKGEMERELAKEEEEEEEEEIIGDEREGEDEEEGEEGEGEGSWLLV

SEQ ID NO: 7593 - protein, 1190 aa, Aureobasidium subglaciale
MSSSTSQVALPDALKDIFEFDEAEKVVAKYPCWYLQSVLLQGYIYITQRHICFYAYLQKKTGVTTKSGYLTKRGQRNPRYKKYWFVLKGDVLSYYKDPLTPFSPRDVIDLRYGVSAEVTTTQGKDQESSSFCVVTDAKTYHFRAETASSAAEWVKQIQKVIFRARNNSDSVKICLPVDNVVDIEESSYPDFADTIKIRVIDNDETFAVDEYFFSFFGFGDEALRVLRSLTQETSAQRVLSSRPVSPVLTKSDRRPSSTHGRRSRLSSTSPAPGGIHENVMATLSPASGLATKSARSSSELEHSTLDLTQAKEERYVKHSAIQEGSRKQRNWGKATRDPSESYMSSSDQGNDSEMSESATGTDASGSHILSGSVMFHKPTIGKHDTDHAALHTASTSAQTNVSSASAKRPSNEPEAKPFVKSIPNSQVQDMHQSDSSTLGGLMKVGAVPIQRASGFLYNSGKRVSGLFGSSPLEYYDKFSGMIAGGRKHYAEADELVPGEEVQDSEDEMTVREAEKSFRSHFALPDSEKLVATFFGFFHRVLPLYGKLYVGSTRLCFRSFMPGNWTKLVVPFKDIMDVDKERGFRFGYSGMVVVIRGHEEIFFEFGSQDLRDDCTVTLLRSLNALEFSQESVLLTEDEKRDAEAAAAENLLLQEARQGDQGGVEFQPHRDIDQSEQDSPAIFFDDPAASVLDFKPQESLRITCLTIGSRGDVQPYIALCKGLLAEGHRPKIASHAEFGDWVRSHGIDFAPVEGNPAELMALCVDHGMFTPSFLYETNQKFWPFVRGLLKTAWAACQDCDLLIESPSAMAGIHIAEALDIPYFRAFTMPWTRTRAYPHAFGMQNNRMGGAYNYMTYIVFDNIFWKATSSTINKWRKEDLGLKPTNMEKMQQDKVPFFYNFSPSVVTPPLDFGEWIRVTGYWFLDEAEGFTPQKELLGFIKKARADKAKLVYIGFGSVVVPDPKQLTLDIIAAVKKADVRCILSKGWSDRMDKKDARALEVPLPDFMFQIASAPHDWLFRQVDAAVHHGGAGTTGASLRAGIPTIIKPFFGDQFFFGSKVQDLGVGQKVLKLTENALGKAIWIATHDSRMIEKARKLGEQIRSEDGVGNVIKAIYRDMEYAKTLVQQRVARAAQGDTDAEDEEEVEVEDSWTLVENDSDPEATSPTAMMQPQSPSLAAKGKGKLGLSYLPLRT

SEQ ID NO: 7594 - protein, 1334 aa, Kalmanozyma brasiliensis
MKPSKGRLQALTRDGTSDDVSTPQGSNSPLDGSVATIGPGPSRQKRISLTQSDIIPSSRDSTLSRGVKKPSNLRSQLHTATSASVASSASGIDNNDDAQDNGKHQSGTNPFDQDPTDAHSTSLQDQHNLSEAEQRTDHGSIQHLIRPYLDPRPPTEPEFDNVELDHDRLLRQLKDIFQLDAAETLLLAQPCWLFRSLLLQGHLYLTSSHVCFYAYLPSRDEKTIRTGMLGKRTRRTHRFSKHWASLKGGKLSWFGNDRDPYFPQGHIDLRKVSAIEPSDNHTDHFKVTTPARKFTFLTEDEASRDAWIASLQKETFRAQNQGESVRISIPLETIMNVETTLSVDSTEMVCITVVDEAGDFSIDEYYFLHLTKPSAFVSGLNALLDQAGKGSVSSLQAGEAGLSFSKLSIRDSTGAAHALTASRKSLEEVPTLPRVRVAQLAEAADPEAYQNKTSRIDATGAPDSSPRQSKAISGESAPTAAMAVPMGKRRESQDGSNDAILSSTPRAALLNRLSMESSHTYPPSPSVSDPPSMFGQVQKEADRGWAIPDWLKQAPAMVLGRASESSSTDTRAEATTSGTGTRRHRKVLEKWSDEKSADDVSRGESSNTDTEDDQLSQSIYSTQSAYSMLDTEEEAMEASSHTNIAAEFRDTFGIGEDEGLIGHTHAYLYRVLPVAGRFFVAEHHLAFRFSGIAAKTVGRTLMLVPLQDVISAAKHVAFRPGHHGMVINISGHEELFIEISSAHRRDELLSLIEYQLELGKGGRGSRASREAATRERSNALVLRDLSERINDGLATDSMTSSADSSSLSQTGSKMGSKSGNLSQIGEGSSILSFAPTTPLTFTMLTIGSRGDVQPYIALAKGLQADGHRVRIATHAEFGDWILGHGIEFSEIGGDPAELMRICVENGTFTVSFLREGVTRFRDWLDDLLASAWRACQGSDVIIECPSAIAGIHVAEALQVPYFRAFTMPWTRTRAYPHAFAVPNKKAGGNYNYMSYVIFDQMFWRASSFQINRWRKNLLGLKPTNFDKLEQHKVPFIYNFSPSLVPRPLDWFEWIHVTGFWFLDNPDNSSSKKWEPPADLVAFIRRARERKRKLVYIGWGSIVVPDAEAMTRCVLQAVQKSGVCAILSKGWSDRLSAKGSTAVDAAAAEDVFQVTSVPHDWLFPQIDAACHHGGAGTLGASLRAGLPTVVKPYFGDQFFWGQQIESLGVGSCVRQLTADGLAAALVMATTNTKQIERARKLGEQIRSEDGVANAVKAIYRDLDYARSRVKRDTRIEGVRSATQAKQGSAASTVGSGPTQQESEEDEEEDAGNISDEWSDIGGSGRLDPGASTFLS

SEQ ID NO: 7595 - protein, 932 aa, Rhizoctonia solani
MDKHDTPFYMREESGKNVVPDTFETDNSEDSNNITKIEIGSIKTSPAINYATYKALGKGLSSSANMTPDGRIVITLDLHKKLPDLPKDYANPVREYAVDRVDWRVAPPMSIVIMIVGSRGDVQPFVALGKSLKEHGHDVRIATHETFRSFVKGAGLRFFDIGGDPEQLMSYMVRNPGLMPGLESLTNGDIGMKRKMVAEYLDGCWKACYEPDDDDDQLSFAADAIISNPPAFAHIHCAEALGIPLQLSFTMPWSATADFPHPLVNVLQSNAETGLTNVLSYALAELMTWQGLGDVVNNFRTQTLGLKPLSMRSGAGLVDRIRVPWTYCMSPALVPKPDDWTNHIDVVGFYFLDLASNYEPPDNVKRFLDEGEPPIYIGYATLVHFRLGAPKDSSYFSFGSIVIEEPKEMTQKIFQAIRETRTRAILSAGWGGLFAPDSPNVPEGVLILDKQTGNIPHDWLFSHVSAVCHHGGAGTTSAGLKAGKPTIVIPFFGDQPFWGAMIAKAGAGPEPIPQDELSTKKLTAAFEFVKSSRARQAAERMGKQIRSENGIALGVDSFHKHLPLLNMRCDIEPHKLAEWWSPEHYLRLSGFAATALTEAGLLDNKKIQHHRTKEYEPHKKATDPITGGSIEIMRTVTHYYAGIAQIFYSPVKGIINTTTAIPRGVMNIIGSVSDGFHNVPRIYGSEVRERGPVNDFSSGITEGAKAGQQSTDGITGLVTEPLAGAKKEGFIGFIKGSGRSYINATMKPAAGIMGMISNPIEGAWKSVQKPWAKKQDSRQLEIRRERGKRAYEASTEEERREVIDAFKRLTNRNATLERKKMMEAEVKEMLQTDASQKLTLSDDRGGSDEERGLSDDPKSVLSPVRSASSDHLARSKDEKVAPPPKLPKRPSQPNTEDEEAAFQRDLDLALRLSLAEQQGYERGLMNSAEAKH

SEQ ID NO: 7596 - protein, 634 aa, Citrus unshiu
MENHGRRCSDASEDVSVDYDAEIESENCNGRGDSSGGQNAARDDASTSSDVRSCSSSERGKVVHNHSLGILSARLFDERVPFRKKMEKSQKHYSIGVGKAKRQILLPDRYAFGDSISLTMSVVYTISLGTIRSCYNDSQATNTTMLIVVQLKWLNRLATVKDDGTVQFEVPADIKPQNLDFGTGVVYTDDSTDQEPIEAADVHGIPRLHIVMLIVGTRGDVQPFVAIGKRLQEDGHRVRLATHANFKDFVLGAGLEFFPLDMVKNKGFLPSGPSEIPIQRNQLKEIIYSLLPACKDPDPDTMVPFKPDAIIANPPAYELLKVPLHIIFTMPWTPTSEFPHPLSRVKQPVAYRLSYQIVDALIWLGIRDMINDFRKKRLNLRRVTYLSGSYSSPLDVPYAYIWSPHLVPKPKDWGPKIDVVGFCFLDLASTYEPPDSLVKWLEYGEKPIYIGFGSLPVEEPEKMTEIIVKALEITGHRGIINKGWGVAESKDFVYLLDNCPHDWLFSRCLAVVHHGGAGTTAAGLKAACPTTIVPFFGDQPFWGERVHARGLGPAPIPVDEFSLDKLLDAIRFMLHPKVKEHAVELAKAMENEDGVTGAVKAFYKHFPGKKSESEPELPHSHRGLLSIRRCFGHT

SEQ ID NO: 7597 - protein, 1377 aa, Spizellomyces punctatus
MVMINVQDSRIDQGEKVTSQSNHFPLTVVGQEESRTSTSTTDIETVRIQQDSEKKKQSRLRKLLRIRPNSDIFPKTYPGPTSAPAVLDVLDLAVVNVPSVEDGTLSSSPPRTKYTDEKSKTGLWKKLQRRNTTPIKRIDRSSEQTEQWTSILIKDDQHQQAKCLPDAPDQCPQFSTPSLPSKDNRVVRFVDSFSDTDEWVADAELDSESDPNSLGSGDDSGNSDGKQRTKKKTKRKTKPRGKSRRLAKKLSHQFADMFSWFGGRGPAGAGSSSEAEAVNNPVLHLVTAALKVENDPDLTPASGDHMGSDHLADDRSSIHSLFLEATDALAEPENTPDTDGDIFSQSSGESDGEDSSPVLTPAGQSTANLTIAEKLQIAFELPETEPYRGEFACWLVRSVLLKGNIYMTDSHICFYASLPREYGSIQHSGFLRKRAKAPRKGSATFWFVLKDDTLSFYRNSTNLYYPLGRVNLKNVVDVQKSKQHQRGFSIVTRDKKYRFKADTETAREEWMKALKASMVRARNEGDDVRIVLPFANITELELSGSSSVTDSLRIKVVDDESALAEEYFFAYFNNLPYAYSTLIDLWQPQRSSPTRPSNPRRKSMYDTTATSALPLKPADVSSRSGLPTPTGSMALLPPAAETPSNSHHRRTQSEHPQSGSPTSESDSPRQRISEDGDATDSSSHPSRSSMSSTSASEFGQSGGEGPSRPASGWRRKLGHRKTRSDAGVLRDMSVVSGIGGSQPSQPTQKQQQHKEIKADEFRKTFALPDSEQLIASYHCSLHRTVPRLGKLYISSNHLCFKSKRVGIRTRLLVPLIDIVDVLEAPGFGWRLRITTRAGDVFLCEFHSPDVRSRCLEVLGRCLREMDCADTKGVERALSPLRHQASILDDIERSDSHVRPSELYNPPVPAALHITLLTIGTRGDVQPYIALGLRLQTDGHTVRIATHSEYKDWIEGFGIEFREVKGNPAELMRLCVENGMFTVGFLREAVSKFRGWVDELLLSAYEACKDTNLLIESPTAMAGLHIAEHLQIPYFAAFPMPWTRTRYYPHPFAVPDRKRKGLGGLGGSYNWMTHVMIEGLLWRGVSGQVNRFRRKTLGRPPIQLGTLNDHKIPFLYSFSPTVVPPPPDWQDWIHTTGYWFLDDSDPDWTPPEDLRQFLEESKGMPVVYIGFGSIVVSDPDEMTRTIISAVLKSNVRAILSKGWSGRLATSTPSEPITYPPQIYPLTKPAPHSFLFPLCTAAIHHGGAGTTAATLRAGIPMSIHPFFGDQFFWADRISDLGVGVTLRKLSVNKLSSALETLVTDTKMQQRARVVGERLQKEDGVGEAIRCIYRDLDFAQERIKHVKTWVDERWGGSTLWSGDKKDKERDIAERRAAESG

SEQ ID NO: 7598 - protein, 2778 aa, Pseudogymnoascus sp.
MPAPSGDGNNLHKYFSSQTPVATMVKKESEESAVPAAKMETPKDSKMSAFERKRLENIAANQAIMKDLSTTAKKIIPKTAAPKPPRSKTPRKREPPVKKEAARPTRTSSRIAGLEADGEGAKRKFEEEFQFAQEEAKAKKMRVAGDLNLSDIAVEGKKWTNDDNLLTSIMRGAQPYERTFDESDIKTTTDQELKSLREKMSGLELYKTWEPNDIKITPERIYSMGFHPTHDKPLIFAGDKIGNLGIFDASQEGEVDDDGDQTAEPVITAFKLHSRTITSLLFPTNHTEMYSGSYDSSIRKLDLQKQVAVEVYAPPSMDDDEAISAIDMNSNDPNLIYFSRLDGAFGRHDMRTKKDTDIWYVSEKKVGGFSLHPLHPHLVATASLDRTLKIWDLRKSTGKGDERQPGLLGEHTSRLSVSHAAWSSSGHVATSSYDDTIKIHSFTKAKTWGVGHEIKEEDMEPTAVIRHNNQTGRWVTILKAQWQQRPDDGIAKFVIGNMNRFVDIYTSEGEQLAQLGGDGISAVPAAAEFHPTRNWVTGGTASDRRQPEGLIAIGTTPPTQIFTTTPASAVATRQNTRHIEVVIPLKRARIMIRSHDDIKKRVGRKLTKKRREDRRVTMEIPQRFEDGDDADEDCTAPKGQNGVINQSVFGMIAAAGSQVDFHSRFDGQESEDDEEDETTEPDDASKPSEDSSDPSTSKPATDERRSRHRLHRRNLSDNKLLRSLSQLGIKHRSKHAQLSTASSDPVTPEKIKYTEKDHAALSPFKGPPIMSQMLEAKAAAVQRASFDSRRSDYISGQSDGADVDEGSPSDLAIQLKEIFEFESPEMVIDEYPCWLMKSVLLQGYMYITEKHICFYAYLPKKSNEIVKSGYLSKRGLKNPKYNRYWFSLQGDVLSYYTDPSDKYFPAGNIDLRYGISASVVDKEKTFFEVITNHRRYQFHADSIPSAKEWVKALQKIIFRSHNDGDSVKISLPIENVIDVEDSPVIEFAETCKIRVIDNDETYAIDEYFFSFFSFGKQALNVLRTLVSDSAAKQIPEDMLVPAQGTSGNNSPKAGSSRPSLTIATKESKPFLNPSRPTTSGLEESVKATLTPLMSSPLHVHSPRASGEFSRTSFDVNHQRSSSQTRPTRRSMEVSRLNLDGNGRNGSPSGDRRSFSRNRAAEKRNSEKQDSSDSYVHSMEESSAAAQSASEDATGSASQILRGSEGFFQPTIHRSASASRRRDDSLLPPTPTLPPHAATIDALERPKLNQADSGSSPSLQTLAKAGAYPLQRAAGFANYLNRHSKRMSTLLATESMGYVEKVSGMWKGGKKHYDEPLGHGLEDDTDDESVGQTEAAQQRFRSHFALPPTEKLQAAYFAYLHRVLPLYGKVYISNRSFCFRSLLPGSRTKLILPLKDVENVDKEKGFRFGYSGLVVVVKGHEELFFEFRQPDARDDCCVTLLQNLETIRFLKETGLLTQEEEESAAWAVAEHKALQEARHESRQHVHEVELPTTAEGASTETAPIMFDDPRASILNFKPTESLRITCLTIGSRGDVQPYIALCKGFIAEGHRPKIATHIEFKDWIEGHGIEFAPVGGDPAELMRICVENGMFTYSFLKEASTNFRGWIDDLLSSSWLACQNSDVLIESPSAMAGIHIAEALGIPYFRAFTMPWTRTRAYPHAFAVPEHKMGGAYNYITYVMFENVFWKAIAGQINRWRKKELSLPRTSLEKMQPNKVPFLYNFSPSVVVPPLDYSDWIRVTGYWFLDEGTDYKPPKEISDFIAKARADGKKLVYIGFGSIVVSDSAALTKTVVNSVLKADVRCILSKGWSDRLDKLGATEPEILPEEILQIKSAPHDWLFMQVDAVTHHGGSGTTGASLRAGKPTIIKPFFGDQFFYGSRVEDLGVGIYLRKLNVSVFARALWEATHSERMIIKANLLGEQIRSENGVDTAIQCIYRDMEYANSLIKRKTGSHHEGLAEDIEESWTFIGDDNDPELMSRIHAWDPRVVMAHAKEGELAKEVELTDSPVPTSRSETPLPSEKEEGNKWLVTALSVGQDIISSHRTYLPHAFADSPKPTEETTMGKPLNLGKKLRYPITVNKLLKTPGDSFAKGDAIFEYSFKWKKEVGDAFGDKWEEELTTIVSFASTADGKLLRWAIRPGMVIEKDQSCAEIDETCSHAVQYAGLCALCGKDMNETSWATDTVDAQRAQINMVHDQTLLSVSQDEASRAEEQLQRRLLKNRKLSLVVDLDQTIIHACIEPTIGEWQRDPTSPNYEAVKDVKSFQLHDDGPRGLASSCWYYIKMRPGLEHFLTTIAEKYELHVYTMGTRAYAQEIAKIVDPGHKLFGDRIISRDENGSLTAKTLSRLFPVDTKMVVIIDDRADVWPRNRSNLIKVVPYDFFIGIGDINSSFLPKREETPKVIAPAPPPAAAAPVSDTQEPTESTTAESSAEGQAQVRRDELATKATSTDANESMSALDELVAMGGGDDPTKREIQAQEQAAFLEKQLKERPLLHMQQQLDKEDNAEGEEAANGTAEESEHTEDYHSHRHHLLKDDDNELAYLENHLLGLHRTFYEQYDKALMNAKGDRVAHLRPGATKKVHMKDEAADLQIVPDIGEVMPQIKANSLKGTSIVLSGLVPLGVDVLRSEIAIQSISFGAQIHTKISRKVTHLVVAANRTRTQKVRQATSYPHIKIVNQQWLVDSMSRWEKVDETPYLINIHREDKSTQQELFDGQNLDESSGDESEADGDSSHDDDADMPDDFEGGQSPIEGLKDVDWSAADAELEEFMASGSESDTESVAS

SEQ ID NO: 7599 - protein, 660 aa, Gossypium hirsutum
MGSNGIDSSRKDLQEENVSNNRSKGVLKDSEQTDEVDESATEYRSSDDQSFSSSYEKEENQKSSSEQKSSVIEVSGTKQSSVSSTPKRGLDHCTSAPLAAQRHQLIDDNEIAFSRSMTEKKNSRHDLKIDRFSEREKVIERLTRWKNLIVNLIKIQNDGTVEVDLPKNSPVASELLELSSIEGPSFDLDDTLFYETTKSIPRLNIAILVVGTRGDVQPFLAMAKRLQEFGHRVRLATHANFRNFVKLADIDFYPLGGDPRVLAGYMARNKGLIPSGPGEISIQRKQLKSIIESLLPACTEPDIETGMPFRAQAIIANPPAYGHSHVAEALGVPLHIFFTMPWTPTSEFPHPLARVPQSAGYWLSYIVVDLLIWWGIRGYINDFRKKKLKLAPIAYFSTYNGSISHLPTGYMWSSHLVPKPKDWGPLVDVVGYCFLNLGSKYRPREEFVRWIQKGPQPIYIGFGSMPLDDTKKTTDVILEALKDTGQRGIIDRGWGDLGQFTEATENVFLIEDCPHDWLFPQCSAVVHHGGAGTTATGLKAGCPTTIVPFFGDQFFWGDRVHQRGLGPAPIPISELSIEKLSNAITFMLQPEVKSLAMELAKLIENEDGVAAAVNAFHRHLPPELPLPTAALEENDHPNPLQWFFLQIGKLCCLPCRLWNS

SEQ ID NO: 7600 - protein, 1411 aa, Candida inconspicua
MVAPKFKKTSSSSSKHDSEVDNKNESSRTTNEVNESQLSQTLDLLKAGPQKVISPATHLLRKARVSVSRKNNERREPHTEVTSDLDDEETLSSPSESDSFNLANKGNPHFLNKSASSSTHIDSKSSLFKRGSSNSIPSPRKLTVTSQNALHRTLSPIRSGVSLVGSSVNIKPKSTPETDFSLDERAQHITRSFANYITAASVFAGFEGLENDEDENGTLILTKDGSGDSKLMAPDNVVKLKDSESTDDTANDSDEEASNSVDIGTNDNSGSDGNDDDDSIITNSTVTNTVDTLMAKHNKAEILRVKNELYSKHSLRNRSQFELSVVQRMIDHVTSPDQKDNVFKKATIVTKRLKEVFHIDEKDNLLGDYPCWLMGDVLLQGHLYITDKKILFFAYLPKRKKNAVVKSGGMSVKSYPSMRMHRKWLILREHTVSIYASSTDLYFPQLVIDLRTALRAETYGSSKDSDPTTPVWVSIVTETKTYWFQAENLDTAKSWVTALKKQIFSSRNKGDEVAIEIPLQNVIDLEISNVFVTTKSLKIKIIENPETFAIDDYYVMFFSQGKDAADCIKEAIENAGLEISLSTDSTNEDWKNSDLIKSKIELLKTTSSSVKSTNFNLTENDDSLDVRNILMSSDEDDSDDDHNGATSFIKKMGYSTGKKLTKNLIPHIRMNRRSSTSNHHDSVDSMLDTSKSRSYESEGDIPEDDSISNLPDDDISVGDQSEGEKYESDEESGKKWSAKYLAHGITNFTSSLLFSGPPQHYDDTLAISKEGQDPYFIADKKKRESAEKRFIKRFSLSDSERLLATYSLYLMKGLPVYGKLYIGSTHICFRSTLPRTNTIMILPLSDTENVSKESGFRFGYCGLVLVIKGHEELFFEFSNSTTRDDCEMQLLKQIEQCKVTDGKDSVPDNSNTEALNSAKLQMFENKLNSDTGMDIPIIVEDHPFEKTNIKPSKSYRFTLLTIGSRGDVQPYIALGKFLMKEGHTVKIVTHSEFKDWVESYGIGFDCVAGDPSALMALMVSNPNINYSFIKEAKAKFREWIDDLLISSWNACQDCDVLIESPSSISGIHIAEKLQIPYFRAFTMPWTRTRAYPHAFLVPDQKLGGAYNYMTHVAFENGYWRGTCNQVNKWRVETLKLPKTNLGAMHQNSVPLIYNISPVVFPPSIDFPDWVKVSGYWFLDEKNNYQPPQKLVEFIEKARRDGKKLVYIGFGSIVVEDPKELTKAVVDAVVEADVRCILNKGWSDRLNSKDKGHIEIDLPPQIYNSGNVPHDWLFTQIDAAVHHGGSGTTGASLRFGLPTVIKPFFGDQKFYGSRVEDMGVGIALKDLNSKSLSKALKEVTTNTRIIAKAKFVGEQIMKENGVQNAVDYIYTLMEYARKLSVSKNKHDLADSDEDDDDLSIDLPKMHGSWLLV

SEQ ID NO: 7601 - protein, 1712 aa, Rhodotorula toruloides
MAHPLIKPSGPDATASTPPRASSPGPSAAYTGYSMSPHKASGSSHASQPPGFDGAPMEDLSGWGKSAERFGGMAQAGLRQEDGTFLHSETNAGSSESQGAPGIRTPLSRQASTSSASSSSSLASSSSSASGFNTTAEVSDPEEDAGAGIGGAGYGRMAATSLDEHTARKTREDQEMNRWREGASQSYHGGMGQGYLRMIHALAQEDAQERRKERREQKKRRKAKKHHRHASHSADDDAGDEQKKEKKEGSNAGDESNADLSKFRSLPERAAANPSLARCDNESPKSTVSSAQRQLLSGSATSASSHLRHQRPNIRAGGRDGEDLSKSSIFAIHRPIAAERRRTMSSTHGTDDESGEPDLAEQDEEYKDEGVRLRRAGKEEGKRPEMGDRTETSATEKTVETMERRQKLAEKLMDVFGLEEPEEVVAEYACWLFRSILLQGFLYITAGHLCFYAYLSQKEGATIRSGSLSVRGSRTRRYRKHWFVLKDSVLSWFPSSTDPYFPDGHIDLHYCVAVEPSTKHSHHFKVSTSEKRYHFSADSEASRDEWVKAIKKVVFRCQNEGESVKIAIPLETIVDVEKSSSLEFAETIRVRVYDADEGYSIDEYWLSYFKNIDGALEKINSVLEAFRSHHPSSQGTKEPLPPSAAHVQEVEDTTRAAQADLGESDQYRQAESEHQPRRSEESVRDVDDDPKRSKSLGQRVSSVLSQTTRLGRSSPKSSRAPASAPSSGPPGTPTKAASTPPNLLSQSGAAPTPISASSTPASGSIATLRPSSQQQPQAGTTPPSDDIAVRGVATVTAAAATAPTPPPVGSPPKMEGDGTITSLAPALSQPPVSLAEEGRASSEDTLSPRQHTYPPEPSTGPPPADGSGNRRTSTLSKILSAPAGAASSFGQGSRKILEVVTLSSVPGRKKSSKKGAVADAAITEEPEDMVAEEEDKAKRVDDFRKLFGLSEKEDLLEEYPAYLFRGLPIYGRVYISNNFFCFRSSGIMPGKSKMILPINDIIGVSKHRSYRIGFSGLMVVIKGHEEVFFEMNSTERRDACLEKLDQQREVVKQMHREQSKQEDDSEEHRQLQDLLDLSASKATESVSELPHPRSEAVPGQPPIMFSSTTSDFVTFQPEKPLRFTCLTIGSRGDVQPYIALCKGLMAQGHHCKIASHAEYRKWVEGHGIDFSPVGGDPAELMQLMISHDFFTISFMKEAVGRFRGWLDDLLASAWDGCQNTDVLIESPSAIAGYHVAEALRIPYYRAFTMPWTRTRAYPHAFAVPEVHMGGGYNYMTYTMFDQVFWRATSGQVNRWRKETLKLRSTSLEAMQQHKIPFLYNFSPVVVPPPLDWRENIHVTGYWWLDNPDDSKSKKWEPPKELLDFLDDAEKAGKKVVFIGFGSIIIPDPLEMTRVIAEAVEKAEVYAIVAKGWSDRASKKEDSEEQKEEEEQAEKQHHDLLDKPFIFNVKSIPHDWLFPRIHAAVHHGGAGTTGASLRAGLPTIIKPFFGDQHFYADRVATLGIGTHIRNFNVDNLTEALKKAVGDEKQIERARLAGEEIRKEDGVATAVECIYRDLEYARSLIPAPAPVDKDGDVSDSSSTSSDDGDEPDSIDEKKPVSSEKAAVAASAPSTPVKPTHDTAVAKDSPPGTESRTTSSDEGWDVMSRGSATGSTWDDSISRASSATRAPRSGNAQEALERDQVEGEPSVEEEPQSGLTARMLGFLGKPIKPGK

SEQ ID NO: 7602 - protein, 875 aa, Colletotrichum higginsianum
MSKRDTVRMVEDDTVPQDYLPSYETAINEGLQQHRDSVRSDGRVDVNLDSRLATTLARFIPDFKDTAELAQAAAAQGPPPEYFEAAERFAEKKTFPVRLNIVIQVVGSRGDVQPFIALGNELQTYGHRVRLATHDVFDDFVRKSNLEFYPIGGDPSELMAYMVKNPGLIPSLKSLKGGDIQKKRKMVKEMLEGCWRSCVEPDPRTGAPFVADAIIANPPSFAHVHCAQALGVPLHLMFTMPWSSTRAFPHPLANLQFGDKGVVDQMTANFVSYSIVEWLTWQGLGDVINDWRKTIDLEEVPFSEGPVLAESQKIPFTYCWSPALVPKPIDWPAYIDVCGFFFREPPQYTPPAELANFLKNGPTPIYIGFGSIVIDHPEEMTKILIEAVRATGVRAIISKGWSNLGGIESDDVLFLGDCPHEWLFANVAAVFHHGGAGTTACGLLNGRPTTIVPFFGDQPFWGDMVAIAGAGPKPIPHKKLNAQNLADAIRFCLTPEAAAAASEVAAKMRTENGVATAAKSFHANLPLDILPCDIFPDQPAAWDFKRGKKHLRLSKRAAGVLLDHLKIDKKNMSLHETRTYFIENRRWDPVTGTASSLMGVGLGMAKGASDIVVKPIQVYHKRSKLKSAEMEDVDVARSSASSDAPTPPPRSPSLAPPRSDVLERPRSAGRGCGSTTGAAMKASASGLGTFFKSYGKFYLDVPLAVTEGLRAAPKLYGEKVEDHAPIKDWKSGAMVGGKNFVTGVGGGFTDLFYQPYKGGRDGGAAGAAMGVGKGVMNMVTKTASGTLGIVAYPVQGAYQSIRTAVKSKTRNGIAAARREEGEYLVRNAPVDVETVLRKFDDMCRASEAGQAKAQGNGFFDFGRKSKDRDTQGTPY

SEQ ID NO: 7603 - protein, 880 aa, Aspergillus niger
MASNRNAEVFELPGDLVMPPTTASNNHPGVFELPGEAVTIPPTPIAADRKSGINITSDGRIDIDYNTTLVRRFSKLYTSHYSPRPTTPPPEYSETALQAANDNGPSLESPPAYTEKTWKIKLNIVIQVVGSRGDVQPFIALGNELQRYGHRVRLATHNVFEAFVRSSGLEFYPIGGDPEELMAYMVKNPGLIPNMRNLQAGEIGRKRAMIREMLDGCWKSCIEPDMATQLPFVADAIIANPPSFAHIHCAQALSIPVHLMFTMPWTNTKAFPHPLANLTGGGDEDQGFRNFVSYSVVNWLTWQGMGDVINHWRKELGLDEIAMFEGPRLAEILKIPFTYCWSPALVPKPTDWPSYIDVCGFFFRESPRYDPPADLLAFIAAGPPPIYVGFGSIVLEDAESTTTIILNAIRAAGVRAIISKGWSNLGGIHDDSNIYFIGDCPHEWLFDRVAAVVHHGGAGTTACGLRKSKPTFIVPFFGDQPFWGDMVAAAGAGPTPIPYKELTVDKLASGIQYCLSEQARMSAVAIAAKMQSEIGVKAAVASFHRNLPLECLQCDLEPNLPAVWSFSQNRRKLKLSKIAAEVLISHGLIDAKHLTMHSIRPIFIENRRWDPVTGGASAVVGTATDVADSVLGAFYKPVLEYRDYRKEREDQSSSIRSTSSVENLSDTLSGHSISTNYKEEPWDSDVAGRSNSTKRSDTGKRKLLGRMAAASGRSLGSIAPTMIKGTTVDFPLALAEGLRNVPRLYGETPRDHGPVTDIKSGFAVAGKGFAWGMAEAVSDIVVKPYQGFQKEGAKGTIKGVGKGVTNMAAKAGSAMFGLMAYPATGIAQSIRLSVQSQTRKLIAQQRHSEGIWLLESRQYTATDNIVATFGQKFKSKKGRT

SEQ ID NO: 7604 - protein, 443 aa, Arabidopsis thaliana
MLFLFSLQEFGHRVRLATHANFRSFVRAAGVEFYPLGGDPRELAAYMARNKGLIPSGPSEISKQRKQLKAIIESLLPACIEPDLETATSFRAQAIIANPPAYGHVHVAEALGVPIHIFFTMPWTPTNEFPHPLARVPQSAAYWLSYIVVDLMVWWSIRTYINDFRKRKLNLAPIAYFSTYHGSISHLPTGYMWSPHVVPKPSDWGPLVDVVGYCFLNLGSKYQPREEFLHWIERGSPPVYIGFGSMPLDDPKQTMDIILETLKDTEQRGIVDRGWGGLGNLATEVPENVFLVEDCPHDWLFPQCSAVVHHGGAGTTATGLKAGCPTTIVPFFGDQFFWGDRIYEKGLGPAPIPIAQLSVENLSSSIRFMLQPEVKSQVMELAKVLENEDGVAAAVDAFHRHLPPELPLPESSSEKKDEDDRPDLLQWFFIQIGKKCCLPCGGV

SEQ ID NO: 7605 - protein, 1347 aa, Ascodesmis nigricans
MCDRPRYSSPPGHKFPRPRRRSNDGKRTTQSLYLPSRKPMSDDEDDQEDVCAPKKDVPQNLNQSIFQLFTHGRLPSRLSNVEEDYESSGEDYGSANNNGKRPAVNTQPLDPIDESVQAAASAEQDALSEGSRSEYGPAPFMSQVVEAEALLQSSELGGEVSTENAPGFAALEGGNVKPGDLAKKISEIFGLPDLELVETEYPCWLLQSVLLEGYMYITKGHICFYAYLPKKADRNTKTGYLSKRGKSTLKFTRYWFVLKGDVLSYFSDPKDLYFPSGTIDLRYGISASLVETKPGIEPTAFTIQTDQKHYYFKADSATNASEWVKAVQKAIFRTHNDGDSVKIAIPKSTIIDVEDSPVLNMTDTLKINVLDPETHVIDEYFFSFFEDGAEALARIRNVVKAYQDEKASKARSGSSTPLASRSGELSIVPPPREFVRTTVVGRSPIGSLRPSPRHSLEFSRSSFDVCRRSSDYTRETLKELSEPGRHSLDDRSRRRTQPKNSREVSRDSSISSTSYGESSGMRISSSASPSGSQILSRSDVFRSPTMKSFKRSFSRSRKHGKDSEHSGYDEPPSPNATIRLEPPTRRHTADSSHGGIESSHDSEGMLDNHSDPTLQEIKKKGKFPLQRASLWAGWIGERSKKAVGSLIPTQPMEYLEKVSGMWHGGKKNYRHPSGIGPPEDLEHDSGDDLELAEERFRNYFSLPVTENLVAAYFGHLFRVLPVYGKFYLGTRHICFRSLLPGTKTKMILPLEVVENVAREKGFRLGYSGLVITIKGHEELFFEFAKQEARDDCVVRIFQSLDKASDVTEDDYRGGSVNATAEREHTYLKNVHKRLEHKDFTQHFPENSQITEDQDSFFDDGTGSIICFKPEPMNITCLTIGTRGDVQPFIALCLGLMKDGHKCKIATHPEFKEWVEGYGIEFAAVGGDPAELMRLCVEYGMFTVDFMRYTSAKMRGWLDNLLLSSWEACQGSDLLIEAPSAMAGIHIAEALQIPYFRAFTMPWTRTRSYPHAFAVPERKHGGNFNVFTYVVIDNVFWTATAGQINNWRKKCLRLPRTNLDKMQPQRVPFLYNFSRHVVHPPVDFSEHVQITGYWFLDTSHDWTPPQDLDNFIKQARKDGMKIVYVGFGSVTVNDPAAVTQAVVQAVQNANVRCVLSKGWSDRMASKDAHIPEVPLPDSIFQIKACPHDWLFKQVDAAVHHGGAGTTGASLRAGIPTVIKPFFGDQFFFANRVEDLRVGIALRKLNVASLTKALKMATTDARIVRKAQEIGKAIRKENGVDTAVQAIYRDLEYARTLIKKHHHHSYISAANAVDNNPRNDEMEESWTVVSEDDSLTQSVGNLRLSQDGK

SEQ ID NO: 7606 - protein, 1552 aa, Ustilago maydis
MATISSQSRLDSPFESAKEPSTDSASASQPAAAGLGRLNVDDKHDDACMLSQASDNLDTPPFPTSPRLDPWSPRDYSTISSLAGSRELGRPAMEPTTKTFTASSLLPESQSKASMSVTPHAAAATQSGLDLVQADVADVAFHAEPQGLMQMLSLVGSTFFDADTEGYTEDDVEDSDLPTHPLPTSPLITNTHYKPEVHCSESEQDRQTPERSTKGRLRALARDDLSEDGSTPQGSRSPLDASVLTIGPSRAKRTSLTQSDIIAPSWDSTITRATRRPTHLRSQLHHVASASMSASTSKLASRDIDQDGQGTLTTSSPFDEESTDTPHVPPTQQQSMESESMPSDADRPTKWSSDPLLIRPYQDAQASDQRHSDVCESDRLRLLHQLKDIFHLDAAETLLLAQPCWLFRSLLLQGHLYLTSSHVCFYAYLPSRDEKTIKTGLLGKRTRRTHRFSKHWASLKGGKLSWFDSDQDPYFPQGHIDLRKVSAIEPSTTNKDRFKVTTPARRFTFLTEGEHSRDAWVSALQKETFRAQNQGESVRISIPLETIINVETTLSVDGTDMACITVVDEAGDFSIDEYYFLHLTKPSAFISGLNALLNQAVRGSISSLQGGDQALSLSRLSIHDSTSAMHAAAISRKSLEEVPVLAKVRVSTQTDKRIAHPTAVNKTVATQSTRGSSDRQDELDKATSTATSVAVPVSIRRKSQEVSADAALSTTPRAEALNRLSMESSHTYPPSPSTSDPPSSFDEVQREAERGWAIPDWLKSAPAKVLGLATDSSSAASMKSQPTNTGARRRRKVLEKWTDERGDDVSRAESSNTDNDDDVLSHSILSTHSNYSMLDADNEAAETSDHTSVAVEFRDTFGIGEDEGLIGHTHAYLYRVLPVAGRFFVAEHHLAFRSSGIAAKTVGRTLMLVPLHDVISAAKHVAFRPGHHGMVINISGHEELFIEISSAHRRDELLGLIEYQLELVRGGRESRISHEAATRERSNALVLRDLSERIHDGPATASMASSANSSVLSQTGPGFDNQSTSLSQLEEGSSVLSFAPTAPLTFTMLTIGSRGDVQPYIALAKGLLADGHRVRIATHAEFGPWILGHGIEFSEIGGDPAELMRICVENGTFTVSFLREGVTRFRDWLDDLLASAWRACQGSDVIIECPSAIAGIHVAEALQIPYFRAFTMPWTRTRAYPHAFAVPSKKAGGNYNYMSYVIFDQMFWRASAFQINRWRKKLLGLKPTSFDKLEQHKVPFIYNFSPSLVPRPLDWFEWIHVTGFWFLDNPDNSSSKKWEPPVDLVEFIRVARENKRKLVYIGWGSIVVPDAAAMTRCVLQAVKKSGVCAILSKGWSDRLSSDPSTPIDASISADVFQVSSVPHDWLFPQIDAACHHGGAGTLGASLRAGLPTVVKPYFGDQFFWGQQIESLGVGSCVRQLTVDSLAKALVRATSDKKQIDRARRLGEQIRTEDGVGDAVKAIYRDLEYATSLIKRDTRIEHMPMVTRTRTTDTALARRGKDTSVAVQDENDEDGHTSDEWSDIGGGSESSPRDETEVPRSSLILNRLP

SEQ ID NO: 7607 - protein, 407 aa, Glutamicibacter arilaitensis
MRLLMIAPGTHGDVAPMAGLGQNLAAHGFDVAIAANPAYQDVVVSAGCRFRELPGDMRALVNPAAPGAKASPKDLRRYLRELQDYFELAASGTMAAAEHGADIIMANAVAPYAYDVAEAMGIPAIGGHLQPNEPSAAYSPMALGASRSFGPLGNKVLGQLFAASKAPYDPPAKRVRQSLGLPARSRASSERLRRQHRNPILHGFSSAIVPRSADWHEGIVNCGYWWPAADPGWTPSQRLLDFLDDGQPPVFIGFGSTQALEPEFIVDVARRTGRRTIVQGEAEIDEPGILGIGAVPHHWLFPQMAAVVHHAGAGTTAAGLRAGVPAVPVPVFTDQPFWAQRIHRLGSAAEPIAYKHLTAQRLASSITGVLANADLADGARRIARQLAAESDSSIPVIRILEQLRARR

SEQ ID NO: 7608 - protein, 1449 aa, Exophiala xenobiotica
MANLDSPSKPSGGRKLQKRNPNLNRMPSSHIPSRLSLGADAQDDVTAPSRGRNAPAQYMNQSIFSMIAAAGSRTDFNARFDESSDSEEEIDEEKATLVEGEAQPATSMDKATLVQQVMTRDEPSSIEKKSKHLSGNRLVQPLPRPSARALEPKGKESVARQDPSPESDATSESSRSNPRDAPVLSRLLTAEAEFQENDDAAHLIPTSPEGQKSRGRAESLPQTVLATRLMEIFGFEKPEKVVAEYPCWLLQSVLLQGYLYITTHHICFYAYLPRKSHTVAKTGYLAKKGRTTSKYKRYWFSLKGDVLSYYSDPSNLYFPSGNIDLRYGISANFSAAKSKQKECKDFSLTTDHRTYHLRADSASSAKEWVQILQKTIFRSHNDGDSVKISLPVQNVIDFEESPVVEFAETVKFRVIESGDSYAIDEYFFSFFSFGQDALQIFRSLLAESAGERASEDLLSPTRKDTTLSSPKRRPAARNQSPAVTPGSPRAQSSPPIKESVRATLLPFPVDEGGRFSPKMSGEFYRGNSPSRSSGDFGRASFDRGRRSGSTSRLEANQSRGRGQSPLAQHHDSEDSYVQSIDKETDSSTAPLSPRVEAQMSASQILTRSDVFHPPAIQRMETLASMSTEAHSEGGTILSTSPRKETYSPIPIRGAADLLAHYSKDTGARAQEIPVQVEPSPTLQDLVKAGSYPLQRAGAFADYLKNRSMSMKKLLATESMTYLEKVSGMWAGDRKHYGENEGIVPDDRGIDPEDEEANVGHGDRFRAHFALPPSERLQATYFGFLHRVLPLYGKIYVSNRKFCFRSLLPGTRTKLVLPLKDIENVDKEKGFRFGYHGLVLVIRGHEELFFEFSSSEHRDDCTVTLLHSLESVRYMTESSVLAKQDEDDAEVAKEEHRVLQEARRSSTSDHQLVLPDTAEAIYSHEESRPVLFDDPRASIINFKPTSSLRITCLTIGSRGDVQPYIALCKGLLAEGHKPRIATHAEFGPWVQKHGIDFAPVEGDPAELMRICVENGMFTYSFLREASAKFRSWIDELLTSAWQACQDTDLLIESPSAMAGIHIAEALKIPYFRAFTMPWTRTRAYPHAFAVPEHKIGGAYNYYSYVMFDNVFWKAISGQVNRWRKKELGLRSTNMDKMQPNKVPFLYNFSPHVVVPPLDYSDWVRVTGYWFLDEAQDWSPPADLQGFIDKARKDGKKLVYIGFGSIVVSDPAALTKTVVESVLKADVRCILSKGWSDRLGDPAAVKTEVPLPADIFQIKSAPHDWLFRQIDAAVHHGGAGTTGASLRAGVPTVIKPFFGDQFFFGSRVEDLGVGICLKKVNVSLFSRALWEATHSQRMIVKARLLGEQIRQETGVQTAIQAIYRDLDYAKSLVKARAALAGDTAGADVALDEVDIEESWTFIGDESDPDLRKQIQGWESPVRGRGPRVKMDPAGLRSMQGVEPVRKSSMKR

SEQ ID NO: 7609 - protein, 799 aa, Botrytis cinerea
MGNPEQHPRKSESFNWDAPPPYEELYAFGNEESGVSTSVQDNGRISMAFVGNTSPLPPIYVAENVPQVKSEPVKLYPRLNIVIQVVGSRGDVQPFIALGNELQLAGHRVRIATHDVFQKFVRDAGLEFYAIGGDPSELMAYMVKNPGIFPKISTLASGEISKKRKMISAMLEGCWRSCIEPDPETGEPFIAEAIIANPPSFAHIHCAQALGIPVHLMFTMPWTATRSFPHPLANIQSIETDPKTANFLSYGLVDTMTWQGLGDVINRWRKNSLDLEPVPVMAGPHLAASLDIPFTYCWSPALVPKPQDWLPHIDVCGFFFRPPPSYDPDARILGFLEAGPQPIYIGFGSIVMEDSQKMTATIMAAVQNCGVRAIVSKGWSKLGQEVENENENVLFIDDCPHEWLFKHVSAVIHHGGAGTTACGLLNGRPTAIVPFFGDQPFWGNMVAAAGAGPAPIEQKSLNVTTLSNAIKFLLSPDVVAAAQTLASRIQHENGVKEAVNSFHRNLPIKALSCGLLPQQPATWYWKKGKKHLNLSHQAAAILVEKKKIHASDLSLYKPRPLTIINRRWDPWTATTSAAFDGAIDITRAITNIGLDYRTEYTRALTRPPSKKQNETGTEVASSRNPLQAGSIAVGKGFGKVGIAMGKTAIDLPLAFADGFHALPALYGDKPRDYGQVKDWKSGGIKGAKSMGYGIADGFTGFFTQPIEGAMKEGGKGFMKGLGKGTVGFLTKPASGIFGFVSYPALGLYKSLSTSTHQGTQGKILLAQREYGMHLAMTQQISEEMAEKIVEQFEWVIEGI

SEQ ID NO: 7610 - protein, 1757 aa, Ceraceosorus bombacis
MSQLINADSNDSQRRREEAELILLNQDHARTTPPDFNSAPTAFGLDHRMKTQGRGSHSDAMEPTDMHAPPSHDAASQFPSLPPSPRLNPTSPSRAGIAGASTISSLAASPLLGSNRSMSSETPLAAVSDLQAARIGSARDPQRQPSVSSLGGSRERAGSIGALPRTFAPLHLDSHHQKDHGDASGLCRVPTTTQIAISTTTGGDDCDEAGIRTRSTTTSTQSDPGLPEAGEHFPILQMLSMMLSMVGSRLVEAEAEADGFSEPDQGVQHDSAATRLEGTSVYGAQSDAEESNDDEYMAKPSAAGPSQPATANAGLLRRRVKRFQGSRSEIWDDTPTPVGSRTPLAASYSAHAAHEARSPHSLTRPSTANRSSRLARGQSSDREADGDAEESNESDLAASTESLAAAGLAPQASKDRAMASRVSSSTESIPPDPSASLHMLSSAVLDRSRPDCHSDSDPDPESPLPHRLATSTADTPLLSADERKQLLAAKLVEIFGLGRTETLLATHQAFLVRGLLLSGHIYLTSDHLLFYAPLPTTHDSSEGDVLQAGALRKKTRRTMRFSKHWAVLGKRALSWYDSHHSPYFPQDHIDLRDIIEIGSSQHSADLQSADDAQPSRTADAATDHASLDFYVQTSYRRFVFSAASQASKATWVAALRSAVMRAQNDGDSVRLSIPLETIVDVEYGGQTGVGPSTSEIAAMPSDSSSSQTASAVPSRDFLCIKTIDGAGEDFAIHEYFFRHKGEPSNLVEVLSDTIEHHNARPRMERRTSSGSVRDTLAGSWQGRTDVGSTRYSSGRGVEISTSSAPIAKSAPAETDAPMATEMLGPKAIPIPPRAAGEISTLPDRDASSETTLPMSQARLSETPRTPNPLGAGTHRYPPASVAGAPPRSLSSSRGARSSLDSTRMLRPHIFPGWMREAGGRLLSVTGPGAERLSAQLAALARQPHRKVQESWSRPLYEADLGFRDWVGASQAPDGSELGDPLWPGNDCDAVRAVESSLDSSVSSNYSLLEGHADQALLAEEADRDHQFRTSFILPKEEALVYHVSASLYRIVPVQGRVFISTRYVCFRSSRMATKTVGRTLMVLPISELVSVAKHNAFRFGQHGLVLMVRGHEELFLEFGSRERRDECMAQIDYRVEELANDVNRVEQGLVSVGDNATKEALMLRDLSQRISIRQGNSSAPTLSGSLGTTSKRADVPFSPTSHSSAASYPSTSLQSFDHARSLHFTFLTIGSRGDVQPFIALGQGLKDAGHRVRIATHLEFKAWIESHGIEFREVGGDPAELMRICVENGTFTVSFLREGVSKFRGWLDDLLKSSWEACQGTDVVIESPSAIAGIHIAEALQKPYYRAFTMIWSRTRAYPHAFAVPTSRAGGNYNYITYVVFDQVFWRASAGQINAWRKTCLGLQPTSLDRLEPHRVPFLYNFSPSVVPKPLDWYEWIDVTGYWFLRRPDGDQSWTPPDDLAAFLKRAKAASRKLVYIGWGSIVVRDAQAMTRCIYEAVRQAGVCAILSKGWSDRLSDRHLQPTEQTSPQPVSPISEDVFEVRSIPHDWLFPQIDAACHHGGAGTTGASLRAGIPTIVKPYFGDQFFWGAQLEALGVGSCVRELTAENLAAALVKATQSPRQIERAKALGEQIRKEDGVKNAIAAIFHHLDYATSLIKLNTRLPGAVEVSTKQPIDQQHSRPDRQPDNEQPAHNLEIALSTTSGSGDMSHSDNLPPRITTAEPDMQGSIASINSGMQTSDAEWSVVSDTDEFAASQSS

SEQ ID NO: 7611 - protein, 1426 aa, Beauveria bassiana
MATSPPKSASGGQDRGLQSNGRGPHKVSTRARGLSSSTPDLPEPLQDSDDSGDEAHAQVTANPMSVNMNQSIFGLIAAAGSRVDFHTRFDGNSSDEDDGSKDLPSGLPTTSQTTVLRPDSRKHKKTLSKHRLLKSFATLPRLKSKSKREPSTLSQPDRFTDELCQSSDASETPASPSTETMAPMARRPSVMSRMLQARAEMSSRSSFDIERRPSTDIPQSQDDDDEASPLARRLMEIFDFSEPEQVIEEYPCWLLQSVLLQGFLYITSKHICFYAYLPKKQNIVAKSGYLSKSGKRNPKYNRYWFRLKGDVLSYYRDATNLYFPHGQIDLRFGISASVTDRDKDGLHFEVVTSQRTYNFRADSAPSAKEWVKSLQRVIFRSHNDGDSVKISLPIENIIDVEDTQMVEFSDTCKIRVIDNDETYAIDEYFFSFFSFGQEAINVLKLFVEDSTARKQLGKDQAVAGTSSGAKTGLGKIHTGKIHDTVKATLSPLSPRRSTTASPRGSVEFSSRTSRDGFEGTDQSSRDQSRPPTSSFIDHSPRRSFSSSRPRSRLSDGGKTPRTGFVPSDSNLQSEKSSMEQPSFSSLHVSGTEDPSASQILHGSGAFQRPTIMRSQPTDQGHLKSLSQSQILQPGSDATFRPARHAATTGHLDQLRQEDEQEARDEDRPLTPSLQSITKMGTYPLQRAGAFADYLNKTSKRMSSLLATESMGYVEKVSGMWKGGGKHYDEPAGLRGDDDDLEEDSDGKIQTSMERFRAHFALPDTERLQATYFGYILRVLPLYGKIYISNQSFCFRSLLPGTRTKLILPLKDIETVHKEKGFRFGYSGLVLVIRGHEELFFEFRQSDVRDDCAVTLLQDLETHHFLEGPDTQVEDAQDDDEYMAERDALKSARQEEYPEHELELPHEVSSLPNAPTILLEDTDASFLSFKPSTPMKITCLTIGSRGDVQPYIALCKGLLAEGHKPRIATHAEFQGWVESHGIEFAKVEGDPAELMRLCIENGTFTLAFLREANSTFRGWLDELLDSAYTACEGSDLLIESPSAMAGIHIAEKLGIPYFRAFTMPWTRTRAYPHAFIMPEHKMGGAYNYMTYVMFDNIFWKATAQQVNRWRNKTLGLPNTSLEKMQPNKVPFLYNFSPCVVAPPLDFSDWIRITGYWFLDEADKYTPPQELADFIQKARDDGKKLVYVGFGSIIVNDPAKMTKEVIDAVLRADVRCILSKGWSDRISSKEDPSKTRPDEPEMPPEIHVIKSAPHDWLFKQIDAAAHHGGSGTTGASLRAGLPTIIRPFFGDQYFFASRVEDLGVGVWVKKWGTNSFGRALWEVTRNERMIVKARVLGEQIRKDHGVDMAIQSIYRDMEYATSLIKRKAGKNEQPEPDEDDEDTEESWTFVGGDEPDPDMVTKKLSEGLDNLVLEKEKARRNHAVRSGA

SEQ ID NO: 7612 - protein, 1427 aa, Pterula gracilis
MHHHVPDPQPAFKFHGVPVAAHDVDTSPESLGMSTDQQPTSTEQQSPGSSRLKRAVDKTVDKVGETLGRSKSGKSSSTNGSPGQSRSRLFSLSRRRKYADDSASSDVDSNEISATPSRPSMTSRKSSSDNAASPRPSGEESPFIRPPSPSTSNTRPSLSAFRGDGSVRAGTQSLIQALQALPWSEGSDDSSSDDAGTDEGAEPLASSLHTIHRPVARSRRTALAHPGFEQHPIHESIVEASEESESDMNEDFDQHTPRISHASPPMHAKAPPALARTGTVMNPRNSMTRTGSMATVRLQRRARLAEKLRDIFELDGIEEVWAEMPCWLLRSILLQGYLYITNSHLCYFAHLPSREDQVLKSGSLNKKAQRTKRWIKHWFILKNDALSWYQSSSDPYFPHGIVDLRYAISCDPLNEKDFRIRTNQKAVHLSADSIPSRDEWVKAIRKVMFKAQNMGDSVKIAIPYSAIIDIEKSSAMDFSETIEVKVLDKEEQGATDSYFFAYFHEIDSALEQLRHAVRAHRAQPALGSPGAVMDTTIGRLTAVPLDRVHSAPISDPHSLTAHSSSASSSSFKLPSFLRPFHDSSSTVAASPLARAESSPEVGPQHEEFTHISRSTNSFVPHEEPSSLGLKTDVEGSALGGDVATPRPGALDHSHTYPPSSSTTSDAGDNALRLVPSSSSTLSNWSVGVPSWLKSGGTRRPLSGGSNSNFDPSDLTASQKVREMYTSADESASSRSVGDMAFSVLDSPNTVLDDEVVEKFHSTFAFDEKEVLLGYVPGYIFRLLPVYGRLYVSSNFFCFKSTNPLVKTRMQLPIRDILAMEKSKGNRLGHHGLIVVIKGHEELFFEFGAVDKREVFYRLLDRQMEDIRKRVANGETESVSSGKREALVLEELEAPPTAAEPNPATDAMSESLPALMFTSASSTFLTFKPATPLRFTFLTIGSRGDVQPYISLAKGLMAEGHHCKIATHGEFQEWIESYGIQFGFVGGDPAELMRICVENGTFTLSFMKEGVQKFRGWIDDLLKTSWTACQDTDVLIESPSAMAGYHVAEALGIPYFRAFTMTWSRTRAYPHSFAVPEHKMGGGYNYMTYVMFDQVFWRATAAQINRWRRRTLHLESTSLDKMEPHKIPFLYNFSPSVVPPPLDWPEWIRVSGYWFLDDADVSSEKWTPPDELVQFIEAAHQMHKKIVYIGFGSIVVSDPRTMTRCVIEAVVRSGVCAILSKGWSDRLQADTRDVPETEAEEPLPKQIYQINSAPHDWLFQRIDAACHHGGAGTTGASLRAGIPTIIKPFFGDQFFWADRVEALGVGSGVRKFTVDTLTDALSAATTDVKQIDRARLLGEAIRSENGVATAIEAIYRDLEYARSLIKGGPRQDDDGTIKEKRNSAHSSVTSLHNGSEDWSVISDQDDSGSSPERSKRSSIAHVVKSVLP

SEQ ID NO: 7613 - protein, 806 aa, Elsinoe australis
MSKGTDVHETSSDDEADTPPPYTQNDVLNQAGLRTDMKGDGRIDITIDSGVARRFSQLLQKRSIKAEEPSLEITKSWNIPMNLVIQIVGSRGDVQPFIALGKELAKSNHRVRIATHSTFKSLVEAAGLEFFSIGGSPEDLMAYMVKNPSLLPSMRTLRSGDIQRKRAMISEMLYGCWESCIEAGPCGTPFVADAIIANPPSFAHIHCAQALGVPLHLMFTMPWTSTTAYPHPLANINYAGVDTSIANYISYGVVEFLTWQGLGDVINKFRGKLDLEPVPTSEGPGLAESLNIPTTYCWSPALIPKPADWSSAISVCGFSFRDPPDYKPPQHIADFLESGSTPIYIGFGSIVLEDPVGMSKVLVDAVQSSGVRAIISRGWSQLSAEVDSNTILFIDDCPHEWLFQHVAAVIHHGGAGTTACGLSNGRPTAIVPFFGDQPFWGNMVAEAGAGPEPIPWRSLDTATLSKAITCCLSPKTTSAAGRIAMRMREDTGVWTATRAFHCHLPLDTLPCSILPDQPASWILDKKSIRLSKLAATILVKNGYVQGKDLKSLATQPIFITHRRWDPLTAGSSALIGTAANMLKFAVGIVRAPYDEIQASAKQEKEMAKKQDMIVLDQDSGASRTTNTTTPASAAFRAIGASARSIGMFNASLFKGTMIDMPLAITEGLRAVPKLYGEDVQNHGVVDGWMSGGVVAGKSFAHGVASGFSDLVNLPLKGSEEEGALGFAKGVGKGTLGFTSKTTAALLGLVAYPGQGICKSIHKSVRSKTRKQVEKNKREEGAYLLSQNRDEGLEEKVVRLYDLLKNA

SEQ ID NO: 7614 - protein, 419 aa, Marinithermus hydrothermalis
MQVAIVAVGSRGDVEPYVALGAGLVARGHEVRMLAPQGFAELIAPFGLEYLPLGENPRALLEALEVRRAFAAGANPYRFVRELLEVYRAFLPGFLRALEPGLEGADRVVFSTLGFPAYHWAEARGVPAVAAFLQPQTPTAAFPAPFGPSPPFLARCGLYNRFSYVAMEQFAWFLVASQTNRWRRALGLAPLSWRGPYPRLRRGAVPVLYGFSTAVVPRPRDWPDWVRVTGYWRLPLDEGWRPPGELQAFLEDGPPPVYVGFGSMRPPDVRRFTEIVLEALQLAGVRAVLVRGWGGLDPERVPDSVYVLDAVPHAWLFPRVAAVVHHGGAGTTAAGLYAGRPTVTVPFIADQFFWGERVAALGAGPRPVPAKRLAPNALARAIRAAVERFAYRRNAEFLARRLCREDGVMEAVRGVEDLA

SEQ ID NO: 7615 - protein, 1435 aa, Sclerotinia sclerotiorum
MAPDDESKKRATRKSTKRWKEEHQVATEIPERFREGDDEDEDCTAGHALNKSVFGMIAAASSIVDFNARFDAQSSDEEYDLGKPTRQSSESHINRSSIDQKMGKFEGHRRLLSESKILRSFSRFSSRSKSKSSNTIARGSRTPSPLRESRQEPTSPEIRYSPLQPKDTPVMSRMLEARAELSLRPSFEMPRKSKDPAEVDDERTSPDSLAERLMEIFKFETPEDVLEEYPCWLMKSVLLQGYMYITTKHICFYAYLPKKANEVVKSGYLSKSGRHNPKYNRYWFRLKDDVLSYYTNPSDLYFPSGNIDLRYGISASIVEKEKGKDSTHFTVETHQRKYNFNADSAPSAKEWVKALQKIIFRSHNDGDSVKISLPIENIIDIEDSRIIDFADTCKIRIIDNDETYAIDEYFFSFFTNGKLALSVLKILVGDTAAQKIPEELLSPLSTADDSRGSSKRTSFQVSRDRKLHGPSVQPNAPALEETVRATLSPLLAPGAGSPRASTDMSLSSSDIFRRSLDINKHGRRSIDLNRLTTEHHRSNSANSISTRRSLSTNRLDQEKRTSKQGSSDSYVHSLEEPGSSEALPSASDETQASASQILRGSDVFLSPTIQHSPSVACNRNKDEIQGPKSRSLTSPIKSADVSPTRTQRPQHPKHAATTGSVSDSNVGQAEISSGPSLQSIVKAGSYPLQRAAGFAGYLNRHSKRMSTLLASESMGYVEKVSGMWKGGKKHYEEPHGIPRDNEMPSIGDDDDNRDGATPADRFRDHFALPPDEKLHATYFGYLQRVLPLYGKIYISDRSFCFRSLLPGTRTKFILPLKDIENVDKEKGFRFGYSGLVITIRGHEEIFFEFNQAENRDDCAITLLQNVETMQYMQDSGLLTMYERESAEMAGAEHRALIQARRGIRSEHDIDMHKAADGGSQSISFDDPRASILNFKPTEPLRITCLTIGSRGDVQPYIALCKGLMAEGHQTKIATHLEFKEWIESHGIEFAPVDGDPAELMRICVENGMFTVSFLKEASSKFRGWIDDLLSSSWRACQNSDILIESPSAMAGIHIAEALRIPYFRAFTMPWTRTRAYPHAFAVPEHKLGGSYNYVTYLMFDTVFWRAISGQVNRWRQKELNLQATGLEKMQPNKVPFLYNFSPSVVVPPLDYSDWIRVTGYWFLDEGANYTPPKDLTDFIANARADGKRLVYVGFGSIVVADSAVLTKTVVASVLKADVRCILSKGWSDRLEKKGANNVEIPLPPEIFQIKSAPHDWLFSQVDAAAHHGGAGTTGASLRAGIPTIIRPFFGDQFFFGQRVEDLGVGVLIKKINVSVFSRALWEATHSERIITKARVLGEQIRKENGVDTAIQSIYRDMEYAKSLIKCKEGKSDDDTLEDSEESWTFIGDDTDPELIKRFYDWESMAHSGTLSDKNMMAWSGSDVASAALSPTRKAA

SEQ ID NO: 7616 - protein, 1415 aa, Aureobasidium pullulans
MLGARVRHSGAPSILVPRPRYCIRKQAGSPSPAAALQPELALSLSLNMTSRRNTPQARRRVSMELPERFRFDDDDDEEDQDQELDRAQPIDMAMMHQSVFGIIAATQSKANTMRSMLQEADSDSDDTTPPPTRPNRSTLDPTTLPLRQSPLSRNKHLKRVSEPNLVQSLPGLRSAPKMTFATTTPTRFSKSDDLPEPIHHGRTDLESSQSTITKPASRKPIPVPDMSSSTTQVALPDALKDIFDFDEAEKVVAKYPCWYLQSVLLQGYIYITQRHICFYAYLQKKTGVTIKSGYLTKRGQRNPRYKKYWFVLKGDVLSYYKDPSTPFSPRDVIDLRYGVSADLTAAQGQDKESTSFSVTTDAKTYNFKAETASSASEWVKQIQKVIFRSRNNSDSVKICLPVDNVVDIEESNYPEFADTIKIRVIDNDETFAVDEYFFSFFGFGEEALRVLRSLTQETSAQRVLASRPVSPVITMSDRRPSSTHGRRSRLPSMSPAPGGIHENVTATLSPASGLTSRSARSSSELERSTLDLTQGREETLASRATTQRNSQKQKWGAFQQDSSESYVSSSDQGNDSEMSESAAGTDASGSHILSGSIMFHKPTIGKHHTDNVALHNAKASPQTDAPFASSNEAGKEPEVRASTRKTSDTETQDMRQSDSSALGGLMKVGAVPIQRASGFLYNSSKRVSGLFGSSPLEYYDKFSGMIAGGKKHYAEADELVPGEEVHDSEDEMTVREAEKSFRNHFALPDSEKLVATFFGFFHRVLPLYGKLYVGSTRLCFRSFIPGNWTKLVVPFKDIMDVDKERGFRFGYSGMVVVIRGHEEIFFEFGSQDLRDDCTITLLRSLDTTEPFQESVLLTEDEKRDAEAAAAENLLLQEARQGDQGGVELQPPRSLDQSDRESPAIFFDDPAASVLDFKPEGSLRITCLTIGSRGDVQPYIALCKGLLAEGHRPKIASHAEFGDWVRSHGIDFAPVEGNPAELMALCVDHGMFTPSFLYETNQKFWPFVRGLLKTAWAACQDSDLLIESPSAMAGIHIAEALGIPYFRAFTMPWTRTRAYPHAFGMQKSRMGGAYNYMTYVLFENIFWKATSFTINKWRKEDLGLKATSMEKMQQDKVPFFYNFSPSVVVPPLDFGEWIRVTGYWFLDEANGFTPQKELVEFIKKARADKAKLVYIGFGSVVVPDPKQLTQDIIAAVRKADVRCILSKGWSDRMDKGKAKALEVPLPDFMFQIASAPHDWLFRQVDAAVHHGGAGTTGASLRAGIPTIIKPFFGDQFFFGSKVQDLGVGQKVLTVTENALGKAIWIATHDSRMIEKARILGEQIRSEDGVGTAIKAMYRDMEYAKTLVQQRVARAAQGDTDAEDAEEAEVEDSWTLVENDSDPDATSPTAMMQPQSPSLGSSKGKSKLGLKYLPLRS

SEQ ID NO: 7617 - protein, 602 aa, Panax ginseng
MPENNATSSGEVTVKEVTRGSTSGSELDSKEAVAASLSNNSSGNASRNFPRVNTLPPDILSSDKFMPPSSQFKLERSKTESRHNNIFAEEAAQIFDDKIPIKEKLSLLKRIATVKDDGTVEFEVPGDVEPQALGVRPQNVYNELDDDPLDAAELQDIPPLQIVILIVGTRGDVQPFIAIGKRLQYYGHRVRLATHSNFKEFVLTAGLEFYPLGGDPKILAGYMVKNKGFLPSGPSEIPVQRNQLKDIIHSLLPACKEPDVDTGIPFKADAIIANPPAYGHTHVAEAMKVPIHVFFTMPWTPTSEFPHPLSRVKQPAGYRLSYQIVDTLIWLGIRDMINDVRKKKLKLRPVTYLSGSQGSDADVPYGYIWSPHLVPKPKDWGPKIDVVGFCFLDLASSYEPPESLVNWLNGGTKPIYIGFGSLPVQDPEKMTKVIVEALEITGQRGIINKGWGGLGNLAEPKDTIYSLDNVPHDWLFLQCAAVVHHGGAGTTAAGLKAACPTTIVPFFGDQPFWGERVHARGVGPAPIPIDEFSLPKLVDAIKFMLEPKVKESAIQLAKAMEDEDGVAGAVKAFFKHLPCRKTEAEPTPVPSGFFLSKCFGCS

SEQ ID NO: 7618 - protein, 2762 aa, Chlorociboria aeruginascens
MPPEEETPKTSAFERKRSANLAINSALLPVTRPTADQITPRPNPKQRSTVSRKKATPVEKEGARRTSSRLAGIEADSETHKRKAEVEYEFAKEQSRAKKRRVSGDLNISDVLVEGKKWDKGYNFLSGVMRGAQPNQRTFTEDDIKETTDEGLRALREKMSGLQLYEGYEPSHIKITPERVYALGFHPTQTKPLIFAGDKMGNLGLFDASQAPPEVKDEDDEEAEVPEPAITAFKIHSRTITSFVFPPDGNNLYSSSYDSSVRKLDLQKGVAVEVFAPESLDIDLPISSIAIPSTDPNLLFFSTLEGSFGRHDIRTPSDTEIWQLTDKKIGGFSLHPLHPHLFATASLDRMLKIWDLRKIVGRGDDRHPTLLGEHESRLSVSHASWSPAGHVATASYDDTIKIHSFTDAGTFKVGQDLDSDAMAPTAIITHNNQTGRWVTILKPQWQAAPEDGIQKFVIGNMNRFVDVFTADGEQLAQLGGDGITAVPAVAHLHPTCPWVAGASESFIALVTTYMQHVMTTSRLTLPSYYCQEIPAVGVGWGLASKFPILIDTKDDLKKRIARKLTKRRKEGHQATMEIPERFKDGDDADDDCAVLPGSSMNQSVFGMIAAAGSKVDFNARFDGQSSDEDEEDTNVPIPSPASDLKVEKTRREESTEKPEKSEKHHRRKFSENRLIKSIPRLGLKSKSKSPATSNKSPVSSSLEGPAAPEIILPRTPSKDAPVMSRMLEARAELELRPSFDMSRTLDGTNINDTEDGTSSNLAKRLMEIFHFEKAEEVIAEYPCWLLQSVLLQGYMYITTKHICFYAYLPKKSNEVVKSGYLSKSGKRNPKYNRYWFRLKDDVLSYYSNPSELYFPSGNIDLRYGIKAVVAGKDSGKDATHFTVETHQRIYNFKADSIPSAKEWVKALQKIIFRSYNEGDSVKISLPIENIIDIEDSQIIDFADTCKIRVVDDDETFALDEYFFSFFSFGKEALGVLRILVEDTTAQKIPEDLLTPVPPSHEGLSPRGGGSKRNSMNIIPETTGEKSTRPPPPVRKVTPVFFEDTVRATLVPLSVSGPGTQSPRASMDINRQSSDALRRSIDLNKFGRRSIEIGRLTMDGAGRRSMSASRRSLSRNRMEGRHQSEKQGSSDSYVHSLEDPGSFGALPSASDDTQASASQILKGSDVFLSPTIQRSSSATCQRELGDASSTEQFARSLSRTEDRPKPRHAATMGSESSHTDRIEPSGSAPTLQSLVKVGTYPLQRAAGFAGYLNRHSKRMSTLLATESMGYVEKVSGMWKGNKKHYADPQAPMPDDEMYGEDEDDQGSGDRFREHFALPATEKLQATYFGYLTRVLPLYGKIYISNRSFCFRSLLVGTRTKLILPLKDIENVDKEKGFRIKYSGLVIMIKGHEEVFFEFSSADARDDCAITMMQNLETIKYLTESGFLTTEEREGAETASAENKALLKARNQVNMPRPPYTVTDDSPPILFDDPRASILNFKPMESLRITCLTIGSRGDVQPYIALCKGLLAEGHKPKIATHKEFQLWIEENGIEFALVDGDPAELMRICVDNGMFTYSFLKEASSTFRGWLDDLLTSAWAACQNTDLLIESPSAMAGIHIAEALGIPYFRAFSMPWTRTRAYPHAFAVPEHKMGGAYNYISYVMFDNVFWKAIAGQVNRWRKRELGLQATNLEKMQPNKVPFLYNFSPSVVVPPIDFSDWIRVTGYWELAAPSDYVPQKELTDFIQKARDDGKKLVYVGFGSIVVTDSAALTKTVVDSVLKADVRCILSKGWSDRLDKQAANRAEIPLPPEIHQIGSVPHDWLFSQIDAAAHHGGSGTTGASLRAGIPTIIKPFFGDQYFFGTRVEDLGVGITIKKLNVSVFSRALWEASHSVRMITRAQVLGDQIRKEHGVDTAIQSIYRDMEYAKSLIKSKTGKTGDDTLEDSEESWTFIGDDNDPELVRRIHDWENTSQSAANAQKHQDSWGKSEKLKPHDHKKRDTAKEEDTMGKLLRLGTKLKYPITISNVLKVPGDIITRKEPIFQYKFTWLKKVGDPFGEEWDEEQTTIADYDSPLDGNIKEWMIHEGMTVDKDMDFVEIDEECSHAIQFAGLCGICGKDMTEVSWASASMDAERAKINMIHDQTKLTVSETEASRAEEDLQRRLLKNRKLSLVVDLDQTIIHATVDPTVGEWQSDVNSKNYEATQDVKKFQLNEDPNVYYVKFRPGLMRFLDSISELYELHVYTMGTRPYAQSIAKLVDPTKRLFGDRIISRDENGSVMAKSLARLFPVDTKMVVIIDDRADVWPHNRPNLIKVVPFDFFPGIGDINSMYLAKRQDIPKLAPPKKVVTETPENKEPELAGLTEATETVETPEETPMPEIQHKAEEKGKPERSGANDDAPIGDRVSAFEELVRMSGGDDKELLQEQADEQEKLLEKQVSERPLKHAQELLDQEDCGSNNNDNHKLLTEDDDQLVHLERSLTLVHKSFYDEYDSALHNAQGGRVAQLKPGRNKKVAIKEPAADLKIVPDVGMVMPRLKAQVLADTIIVFSGLVAIGVEPEKSEIGVQALAFGASLLSQQIATPKDEELANATSSLQDSDESNDDTDDEEESFSNSQEEQDDEGVMPDDVKGGLSPIDDLKKFDWGEIDDELKEFMGSEEDSDSDSGSDTSSRSSVRNTPQKRKHDELTTDNDDSDGESTLSKKQRIAGTRGTGLKTSKTPSASQSESSLPTPGVTGDENDDGEESTDPAPTTDDFDDDLEADLEKEMMAEFEREEQEARDSGGGEST

SEQ ID NO: 7619 - protein, 407 aa, Gloeocapsa sp.
MRITILAIGSRGDVQPYIALGLGLQAAGHQVQLASYARFAEFVGSYGIEFAAVGANPQEYIQALAKNVDYWRIFSDNLEQLLEDCWNCCQGTQAIMYSQVALPGYHIAEKLNIPCFAAFTNPLTRTRAFPHPLYTSSANFGGTYNWLTYVVHEQLRWQSVRQKINRWRQDLGLSPVPFAGLYSRLQQQQIPILHCFSPTVIPKPKDWSDWAYVTGYWFLEHLPEWKPPTDLVNFINSGMPPIYIGFGSMSERNSETVINLVLDSLVQTKQRGILFSHWGGLQNVDLPDNVFLMTSSVPHDWLFPLCRAVVHHGGAGTTAAALRAGVPSVVIPFGVDQPFWGQRVADLGVGTLPIRQQELTQDKLIAAIHDVIDNKIMIDRARVLSDRICAEDGVKRAVEIIQSYLHA

SEQ ID NO: 7620 - protein, 1585 aa, Cryptococcus neoformans
MSPPISPTPPPLQPPFPPTAIARGPDRPDPPPQHQQAAESLVNAAAQHVAPTCPPTSDELPQMEDQATNSSNDSLIPSRQAPNQEETENAITAGTPPDEMEPTKDAQTVRFSSSSPASYSTHEYPTEEINEPRTSSRAPNTASSQMAESSFDFRSSRDIGSIRMGASALVSALNALPWEEDDDSDDGEDDDEFIEPARGSSSTIYERKQRPQTPSTSHGFHPTHTLHFPFRQNAIARRACQPGTTELDYQYATPETSSRRTSAAGSESSSEGEVPLPKGFVSHPNLIVPSGEGEAAAHPDPKLISDRITKEQQIADVEEQAEILRSAEEQEMRLGKEFVPPKSRDSADLNVDAALREGGSEREDVIEEQMQTNEAEKRLTRNEKLAERLMEVFGLEEREEVLEEMKCWLLRSVMLKGYMYLTKRHICFFANMPNENNLLVKSGPLHKKASRSKLNTKFWVVLKNDVLSWYESTSDPYFPKGNISLQYCHSCDAVSGTRFKVRTSERNYTFTADTESSRDEWVKAIQKVMFKTQHEGETIKLIIPLEAIVDVEKSPTLEFTETIEVKCIDAEDQMSVDSYFFASFPDNDYAFSAIQKLVRERPSPPELPRISSVTTIHANQEPLDTSHATIKRHGTDSSAEKLGMASHRPFRKISSVLKPLILKSSDGEPLEEHSQGPHHNDEDASHLPHIEAISNRRRSEEESDNDYFDGYPPRQVGPPPPSMNDDARNWRPSWIRKPASKLFGSSPSGSFVSHPGRLPTDSSTTVTESGPSLRSRTGRTKQASVTEVIEPPIQYEEEVSEDEMSNKPSVVDSNSAETARKRAARLSWTSETSSGSQMVKSKSDFSMLGSESGHSESAETVRKFRTFFALSDKEELIDHFPGYLYRVLPVSGRFFISTNYFCFRSSQLLYKTKESFRLMIIPIRDLYGLKAQKAFRFGHSGLTVVIKGHEEIFIEFRSASRRKACIALLEERMEAVRLSGENTIVDSHKIEARIMEDLDESTPVEPKSPWPVSPSPLFGSTTSTSFLEFKPEPMKITCLTIGSRGDVQPYIALCKGLQAEGHITKIATHGEYKAWVEGHGIAFESVGGDPAELMQMCVDNGMFTVSFLKEGLQKFRGWLDDLLNSSWEACQGSDLLIESPSAMSGIHVAEALRIPYYRAFTMPWTRTRAYPHAFAVPEHGRGGPYNYMTYTMFDQVFWRAISGQVNRWRRNVLGLDATTFDKMEQHKVPFLYNFSPTVVPPPLDWTEWIHVTGYWFLDKADEKQGEKSWTPPQGLVDFIDKAHGEEKKVVYIGFGSIVVSDPEEMTRCVVEAVVNSGVCAILSKGWSDRGSKKGEPKGDSEGADGVKYPPEIFAIDSIDHGWLFPRIDAACHHGGAGTTGASLRAGIPTIIKPFFGDQAFWAERVESLNVGSSIRRLTSHQLASALIKATTDEKQISKARVVGEMIRKENGITRAIEAIYRDLEYAKSIIKSLPSTDDRTPERISSLLHPLTTADLSFNRVRSRSRSRSRSSQGRFSPRRHTVDDDGWSVVSGGSRSRSGSASAVTSPERRPLNIGSALGSHVFKTALLPNTFGKWRNLEEGDDR

SEQ ID NO: 7621 - protein, 842 aa, Rhizoctonia solani
MIIPNGHDDKSAPSQHEDQYIRDIRLSSECGVNPQFTSGSALPESDDEEPGPPQYEAPIHGTRSLQPLVDDKSGKDNKRESILSQPSTSSSIPEPEPDAEFRTAAMQASAAFQSDGRFQVSIDESPGSLPREYASPIDEPGVDLSNFANAPPMNVNIMIVGSRGDVQPFLALGKRLRQHGHTVRLTTHETFRQSVKEAGLRFFNIGGNPHELMSYMVRNPGLMPGIESLTNGDITRKQMMVAEMLERCWRSCYEPDDVQEGSLSFSADTIISNPPTFAHIHCAEALGIPLLMSFTMPWSPTTAFPHPLVNVRTSQAEPRMTNYLTYGLADAMAWQGLGHTINKFRRKRLGLPPISGAGIIERCNVPWTYCMSPALVPKPQDWANHIDVVGFYFLDLATKYTPPEDLVEFLGVGKPPIYIGFGSIVVQDPIAMTKTILSAITQANVRAVVSAGWGSLDSSALHDAQNPNIFILGNVPHDWLFERVSVVVHHGGAGTAAIGLRCGKPTVVVPFFGDQPWWADQIYARGAGPAPIPHKQLTTLALVDAIKSALSEETKAAARRVGELIRSEDGVKNGMDSFHRHLPLLNMRCDLDPRKVATWYSRSHKLRLSAFAAQVLAEKGVLDVNKLELHRPREYITRVHHTNPFSGTLSPAVGVVGDVVGGVGGLFTARPEKGVIKLVKAGPEAARGILEGLHHGMNNAPKIYGGSVREPGKVTGFKSGLREGRKSVVMGFYDGFTDILKEPVNGFKKHGVLGGVGGVVIGLTNAVVKPTAGIVGMLSQPVEGTFQSARSLLAKPATERHATRYAEGVAAFKESNEAEREAVIRMFEEKARSRMKGKQKSA

SEQ ID NO: 7622 - protein, 997 aa, Schizophyllum commune
MPQVPYYMRDPEASPPAYEASGSRSRSQSPRPVTVNGTDINYAEWKAIGKGLVSAARVAPDGRIGVTLDLKERLPDLPEDHAPQVAEFGVDEGNWQKYPSMSIVIMIVGSRGDVQPFVALGKRLHSDGHRVRIASHEKFREFVNEHGLEFFDVGGDPQELMSYMVKNPGLMPGMESLTNGDIGKKRKMLSEMMNGCWKACHSPDQKTGRPFVADAIISNPPAFAHVHCAEAMGVPLLLSFTMPWCATGAFPHPLVDISFSNAEERLTNYISYALADILTWQGMGDIVNKFRNRALGLPSLSVRSGPGLTDRLRVPWTYCMSPALVPKPSDWSNHIDVVGFYFLDLATSYSPSEDLKAFLDAGETPVYIGFGSVVVDDSAEMTRIIFEATKRAGVRALVSAGWGGLGGVSVPPNVFILGNIPHDWLFSDGRVSAVVHHGGAGTTAIGLAKGLPTVVVPFFGDQGFWGDMIHKAGAGPEPIPHKKLTAENLAAALTFAISAPAKMAAQQMARQIDSEDGVRAGADSFYRHLPLLNMRCDVCPERMAVWWSTELCLKLSAVAAQTLVDAKEIKMENLDLHRPKEYDSRRAYNDPLTASASGIFWTILHHYAAVAQIFTSPMNGIVKTTTAIPQGIYKIVIGTHEGFVNLPTLYGSEVRKSGPVKGIASGIKEAGKVCYIDQSLVTEPVKGAKKEGFMGAIKGSARSFVNVTLKPAAGIVGVIGLPLQGMLRSIQSPHSERQEKDQRAARLQEGIEAVKTLSKKQRDEIPRAFWALRAGTAERRRRLTALAEEQIKEAEEQGPVERPVFDSTDSASTLSGRSGSAEGSARGEGNTVVGGASSGSNLGHVKSRSAESTSSASVRSFGASSTSGRSVASSSSPRVHFNPIDTAKGPSSPGKYAASRSGKQSSSLGKKTSIDYDKLYEDDLAYAMRLSQLEGPTVDGAAGAPVSLSTGEAPLAMPGSFETEPEPPHETTAASREDADEQAFQRDMDLAMRLSLG

SEQ ID NO: 7623 - protein, 1131 aa, Auricularia subglabra
MSTIRQNRRAQLAKKLAEVFEIEGIDEVVAEMPCWLLRSILLQGYMYLTNTHLCFFAHLPSKEDQVLKSGTLNKKAQRTKRWNKHWFVLKDDVLSWYHTSTDLYFPHGVLDLRYAISCDAQGEMGLRLRTTQKIVELSADSVPSRDEWVKAIRKVIFKAQNLGESVKIAIPYAVILDVDKSSAMDFSETIEVKVVDKDQHSGYSVDSYFFAYFKNLEHALEEIRQIVKTYRVSPTQEADDVVKDTTAARSPSHSHTTFDHAHAATEDSRSSKFMSLLKPFSTTDATAALSQSIKRLSSEFPFPTSSSPGHGTPTSPPPSQEDVSSSTSTLARQSRHGLEGDPATILGAPLQLSPSPSQSSSSAHTYPPSTNSRPVPIELPSASSWNFPQVASWLRNPTKLFSAPPGAQRGGVVEVLSHSRRHSHSMPQSGDNSQEFGFSILESHDAGHDDVDPMIADKFRDYFAFDERESLLGYFPGTLFRVLPVPGKVYVSSNHFCFRSSSRLTRTRMIIPIRDILSTERTKPFRFGQYGLVVVIRGYEELFFEFNGADKRNACADLLAVQIEGAHARLHAGDVSSPAPSKRETLILEDIEQEDIMRHHRHDSEPRPPPESGSETVPAVMFTSTSSTFLTFKPQESLRITLLTIGSRGDVQPYIALGKGLIADGHKVKIATHAEFKEWIESHGMEFGYVGGDPAELMRICVENGTFTVGFIREGVQMFRGWIDDLLKTSYEACKGSDLLIESPSAMAGIHIAEALKIPYYRAFTMPWTRTRAYPHAFAVPEHKMGGSYNYMTYVMFDQVLWRGTASQINRWRRRLLGLPPTNLDKMEQHKVPFLYNFSPAIVPPPLDWYEWIRVTGYWYLDDADVSAKKWQAPQDLLDFIASARDAGKKIVYVGFGSIVVPDPTSLTRTVVDAIQQSGVHAILSKGWSDRLANKKRVAQTEPEIQLPSSIFPIASVPHDWLFSRIDAACHHGGAGTTGASLRAGIPTIIKPFFGDQFFWADRVEALGIGSSVRKLTVESLAQALHAATTDEKQIAKAAIVGQQLRAENGVATAIECIYRDLEYARTLVHRRHSDHLEENATIREKNYSLPSSSDHSPSNESHNGSSAAGAPSEDWSVISSGGPDEDRRAR

SEQ ID NO: 7624 - protein, 437 aa, Asaia platycodi
MKIVIFTIGTQGDARPFVALGQGLARRGHDVCIATSARHESLIRGGGLGFAPIESDFADLMTQEHAVLEKGNQLRMGWQVARALCRWMPLWVRQAMEATKGAELVIGSGSGTILGASIAQRRGIAFVQAQFMPMTPSKWVPPLWPNPALRLPGILHKALTHVARFLIWRFMSFPVAIMRRELSLPPIGWKGPWSETDSAGNRRYLLYAFSRHIQPQPADWSRDRIAVTGSWFYDQKTSWRPSPELEAFLAAGPAPVYVGFGSMMTGKPEKFTALILKALRLTGRRAIVATGWGALKNLKPDQEGDIFFIDNAPHDWLFPRVSLAVHHGGAGTVAAATRAGLPQVIIPFLADQFFWSWRLKVIGISPIRLSRRTLTAERLAEAIGRATTRAPRDKAASLRPLIEAEQGVESAIDILEGWGLLRQETGTATLTTGISPR

SEQ ID NO: 7625 - protein, 424 aa, Chondromyces apiculatus
MNICLIGIGTRGDLQPLIALGKGLAARGHRVRVLAGAGFLRWIEGHGLEAVPAELNMETLMRSELGRTWADTGANPLVGVKMMRRLFAQQDEILAADLLRAADGAEVILSSITTVVHTASIAEASGALHVCLPLQPSPLATRHGPSALLAAAPHRDSALNLLLGKLLEETLWRISGAFANRLREERLGLPPLTRGEAMAMLRRTKMVHGCSAHVAPRAPDWPDVWEVCGYWFLDEGKGYEPPEALTRFLDAGEPPLCVGFGSMTTGDPAAVTRLLVDAVTRSGRRAILLSGWAGLGGVALPESILRLDSAPHDWLFPRVSAVVTHGGAGTVAACLRAGRPAVVVPHIADQPYWGRRVEELGLGPAPILRPRLNATRLAAALQATQDTAMQRRAEAMGEKIRAEDGVTVAVARIEQHMEAHRRGG

SEQ ID NO: 7626 - protein, 828 aa, Eutypa lata
MGTYPLQRAGLFANYLNQTGRRMSSLLATESMGYVEKVSGMWKGGRKHYHEQTGLKTDDELDYEDEDAQVASATDRFRAHFALPETERLQATYFGFLSRVLPLYGKIYISDRHFCFRSLLPGTRTKLILPLKDVENVHKEKGFRFGYSGLVVVIRGHEEIFFEFSQGDARDDCAVTLLQSIDTARYLRESMILDQGEQELADEAIAERDALQQARLQINPEHDIKLPQQAPSLSDSSPTILFDDPKASFLNFKPAQPMKVTCLTIGSRGDVQPYIALCKGLIAEGHKPRIATHLEFKSWIEGHGIEFAPVEGDPAELMRICIQNGTFTWAFLREANSKFRGWLDELLVSAWTACQGSDLLIESPSAMAGIHIAEALGIPYFRAFTMPWTRTRAYPHAFVMPEHKMGGAYNYFTYLMFDNLFWKATAGQINRWRNACLGLPNTSLEKLQPNKVPFLYNFSPSVVAPPLDYSDWIRVTGYWFLDEGTEWTPPDDLREFIEKARRDDKKLVYVGFGSIIVPDPAKMTQDVIDAVLRADVRCVLSKGWSDRLGDGQAASVPEVQLPPEIFQIKSAPHDWLFSQMDAAAHHGGSGTTGASMRAGIPTIVRPFFGDQFFFGARLEDLGVGICLRKWGAGAFARALWEATHSERMVLKAKVLGESIRKETGVDTAIQSIYRDLEYAKSLIKSKAGKNAAHANNASAASVNDQTPAAAAATISTDGGVSLNSEDDEEESWTFVGAGSGSSGDDPDLVNAAKNAAEIESSFLSGGSTGSFLDRSASSSGGGRNGRLASFGASTTTSSRLPPDRTNAGTGGSGNGSGSKPPAVVAAGS

SEQ ID NO: 7627 - protein, 1231 aa, Kluyveromyces marxianus
MPEESSPERSRSPSRFSKSMFIAPKAFVRKSLSPVDHIYHSVADLRFSSSNSETLESTLQAINKKMDSIDVSGGAVTGGGGGNEVSDDVAQPQCMAKSFAGFLATASMYAGMDELREEEEESNSSDEVELLNDAATTILDASSQADRTLFDFSIEMNQDALSQPSTASKSRKDLVREKLLKKFIPDEDEHYVEEFPCWLLRDIMIQGHIYLTNKHLFFFAFIPNFENDFHLSGSLQFVSGPSLGKSHRYWVVLKGRTLTFHGSSTDLYFPLLAIDIKDIQYAKISAREAHYAKFEIKVKNDVIELRADSFHSARHWVSSIKKQIFASQHSDTNTITVKIPLQNIVDLDENAILDQSGTLRIKALENTSGYAIDEYFFVFFQGSARKMKNKINSLLKDLELSGSQILIDFKKVESATDLSNSGKNADSKKNSSDLLVDSVEDTGSVMDNDMAASTAPLSAPISELPTSDTGHVSSAYPKRVKKRIKSMASSLRLTSPNKLERLEDDIIIEHYSPGIIHDPSVEVEVEPDKDSKSIISRLTPKKFQNIPTMWAADPVHFNVKNDAFFPLDDKYAADANDSEHSDKRFKFHFSFDNTVTLLASYHGYLNRNMPVYGKIYISDKNICFRSLLPGVNTKMVLPLEDIENCSKETGFRFGYFGLVIVIQGHEELFLEFSNKNARDDCEFVLMKTMDINGHTNTERKKNARLDSIHKISEAANLKLLEEKISEQGYDIPLIVEKNPYFTTTIKPNKSYKFGLLTIGSRGDVQPYIALAKGLMAEGHTVVLLTHLEFKDWIESYGIEFREISGNPAELISLMVQHGSMNVGLLRDASANFTGWIGSLLQSAWEGAQGIDILIESPSAMAGIHIAEALEIPYFRAFTMPWTRTRAYPHAFIVPDQKRGGSYNYFTHVLFENIFWKGISGKVNEWREKTLNLPKTNLFTMQQNRVPFLYNVSPTIYPPSIDFNEWIKVTGYWFLDEKLSYDPPPAFVSFLKKARELKKKIVYIGFGSIVVNDPQKMTDTIVDAVLEADVFCVLNKGWSNRFGDKDAKAIDKELPACIYNSGDVPHDWLFTQIDASVHHGGSGTTGASLRAGLPTIIKPFFGDQFFYASRIEDIGAGVALKKLNKTSLAKALTEVTTNTRIIRRAKHIGELISKEHGVETAISCIYSELGYARSLIKKKSETSSYENLASTEDFSTDHSDSDARRIPTEQEELSEPSTEESGASNDGSWLLV

SEQ ID NO: 7628 - protein, 405 aa, Streptomyces sp.
MRVVLTAWGSRGDVEPLAGLAVGLRELGAEVRVCVPADEEFAQLLDRAGVPLVPLGPTVRSIVTRPKPPGAAAAFQLAPELVAARFDTLTTAAEGSDVLLATGLMPSGARSVAEKLGVRYAFACFHPFGLPSKHFRPGARPGTPSPEEETDLEVLWEQDGQRVDQLYGEAENRHRAAIGLPPLAGVRDYALTSPALLAADPLLAPWKDLTNLELVQTGAWFLPDDRPLPHDLETFLDAGEPPVYVGFGSMAMHSSPDLPQVAVDAVRAHGRRVLLSRGWAGLASVDDRDDCFVLGEANHQALFRRVAAVVHHGGAGTTQTAARAGAPQVIVPQIVDQPRWAARVAELGIGAAHDGPTPTVESLSAALKTALTPETQDRARSVAARVRTDGAKVAAQLLLDGFPDA

SEQ ID NO: 7629 - protein, 1629 aa, Tetrapisispora blattae
MLHLQQAQQKIIIPPSASATVQSLLHPRSRSNSIDNNSKNSTLAADVSLASNITVKDSELIDLDTNNKPIPNVSTTQDSSSILRSRSKSPDSRFKKINKEALNLPLNSAKLVIKSVQRPASVVSEVPIGLTKGLSHVVGKTSSDILTIHEKIRSRTRSNSLNSKKSTLDSSILDSPTIGTTIEPGTSTTGQEDDLANSSSLMKGIVGLLTTASVYANMEKQKGFENLENDLALETDEETEEEEEQTIANPDDLSLNELHDDVLSPVTSSSIATIKPPMKIIDTSSTIEGTKSDDPNLNEEFVDASSEVSITNSNHTSSSSLSSEDNWKDARNNNLEHISSKQQKENSLVSNQLASNDINSLSKTSLEKEHVNPTLYQSQTQNNKNKSIENESISDINSNGSTGINRKPNLFSISIEPACDSLEDMASKGTSKTDTESNKGTLPKIIVGSANEDIPTQTLQRQLSKTESGISQLSPTNKLLEKFRETFNLSSDEKIIKNFSSWLLKDILIQGHMFVTKYHLLFFAFLPKSSGTVKLSGNLNVFSKIRGSSRYWCVLKDDIFTLYTSPTDLYFPAFTIDLRDVEDIQLMKNKKTKELTKKFHIITKSKKFKFIADSEYSAKTWYNTLKRQQFTCQNSENNSISIKIPLLNIIDISDQNIANEALTLSISVLESPKTYAVDDYIFVFLNGMGTNVKNALLLQLKQLGDLGVQVLYNDQERLQLLKDEAIELARDKERDRDDVISIISTFKNLNPLGGTISRVRSKSMSAMNIATTKPASPIKPSHLHLENQKAQTSNETLDTEGNTQEEPKDPIHYLNPQNNKVLKIVSPLLPSTEIENILTSASEKSYLHKIRPRSNSWFKKHDTSVEENINLTKLSTGHSTKLNTSGITPETSSKSTPAVLTDAPEAISLDQELVQSGIPSGSELSEIETPTSSKTADDTIVTTQGSRMSRISAPLKNLTGIWIARQLHYPNQYIKFDPNDKHLVKNEDEISDANNKFIEAFKLAKSEVLIASFYAYLNRSIPAYGRIMISQNFICFRSLLPGINMTMILPIDNINGTVEEKGFRFGYYGLVIVVQGNEELFFEVTSRAIRDDLNGLINKIREETQKTAKAHSSSYLINDFEADPEIAKLKLFEDKINASDGFDVPVMIDRSPYFNTNSRPNKSYKFGLLTIGSRGDVQPYIALARGLLKEGHEVIIITHKDFKEFVTSHSIGFEEIAGNPAELMALMVEHESINIGMLREASSKFRGWITELLDTSWEACKRNNLDILIESPSAMAGIHIAEAMQIPYYRAFTMPWTRTRAYPHAFIVPDQKRGGNYNYFTHVLFENIFWKGISGQINKWRVEKLKLEKTNLTLMQQNRVPFLYNVSPTIFPPAIDFSEWTKVTGYWFLDEKNEYEPPKPLVEFIRLARMRHKKLVYIGFGSIVVDNATEMTRAIVEAVKEADVFCILNKGWSDRLGDKSATTMDVELPNSIYNAGSVPHDWLFPQVDAAVHHGGSGTTGATLRAGLPTIIKPFFGDQYFYAMRVEEIGVGLSLKKLNSKSLSKALITVTTNKRMKAKAQLIQSQISKEDGVTTAINCIYGELEYARSLIFSKKRKSNGNEIKQTITAVTNAITTVVPDIRVEEPWTIL

SEQ ID NO: 7630 - protein, 893 aa, Elsinoe australis
MAHYLSHAGRGDVGKQMKKTEMRARADGRFDISFNHRIEAFFHHETHQNGSKTPESPPKGDEQDKSPAATRNMSKLRFRSTEMDYKPVVDTYQGIPRLNIAILIGGSRGDVQPFIALGKALQAPPYSHRVRIGTHAVFRDFVEEHGLEFFSIGGDPEKLMSYMVRNPGVMPTYDSMKAGDVSARRKEIGEMLEGAWRACTQAGNGIDPIEPFADDGDVEKGLDDLLRLPAPFVADAIIANPPSYAHIHIAEKLGIPLHLMFTMPWSPTSAFPHPLANIDASKVNASTANYLSYGRLEYLTWEGLADIINHFREKTLFLDPVHPAWGHQLFSDLKVPFTYCWSPALIPKPADWGDHINVSGFFFLSMASSYSPPPDLQAFLDAGDPPVYIGFGSIVVDDPARLTSIVLDAVRKLNVRVLLSKGWGKLGGDDVPENVFLLGNVPHDWLFPRCSAVVHHGGAGTSAIGIALGKPTVIVPFFGDQPWWAGMIARAGAGPVATPWKKLTAEILADNIEKALSPEMKSRAEELSRKIKHEDGVATAVETFHSMPQMQQLQCFLCPDRVAVWRIRRTNIRLSSMAAACLVLYGKLNPEKLKLLHHKRWLVEEGAQDPLIGLVATFGTLLFGYLGDIHHFKTNLGHKNDDAGTPGSTSGVLQASQTMIVSLAGHTFKAPFNLLYNLANGFHNAPRHLFRDRTVRIRNPITGAASGLKVGLESLGYGLFDAVTGLVTQPYHGYKAGVEKSRDSSALTPAAIGLGKGLAQGLGGLVFKAGAAALAVPGYCAKGLEREMENMMSGSEAITKESIAAMSRARQASFKRSSSAVEKQVDEEAAATMPLWELSTGSGASRYILLQRIWEGYRNIYEMKRKELDGAILLEEQIWTRWSQLRVSDEFVS

SEQ ID NO: 7631 - protein, 722 aa, Chaetomium globosum
MGVYPFRKANALIGYLDRHSRRMSTLLATESMGYVEKVSGMWKGGGKHYDEPHGLRTDEEDVGDDPEDRANSEARFQAHFALPETEKLHAAYFGHLMRVLPLYGKIYISDRHFCFRSLLPGTRTKLILPLRDIENVDKEKGFRFGYAGLVVVIRGHEELFFEFHRAEVRDDCTITILQSLEATHYLHDSTLMDGGADADDAQAAVAEHDALQKARGHRPRIATHGEFKGWIESHGIEFAFVGGDPGELMQLCIQNGTFSLAFFLEANAKMRDWLDELLRTAWEACQGSDLIIESPSAMAGIHIAEALGVPYFRAFTMPWTRTRAYPHAFIMPGQKMGGAYNYVTYVMFETVFWKATAHQINRWRRRYLGLPTTGLEKLQINKVPFLYNFSPYVVPPPLDYSDWIRVTGYWFLDEGNENYKPSKELADFIAAARRDGKKLVYVGFGSILVPDPAKLTQDVIDGVLKADVRCILSKGWSDRVLTKDKDKEKDQLDEKKTPEPELPPEIFQIQSAPHDWLFKQIDAAAHHGGSGTTGASLRAGIPTVIRPFFGDQYFFGARVEDLGVGICLKKWGATSFARALWEATHSERMILKAKALGEQIRKENGVDTAIKCIYRDLEYATQLIRTKTGKNQTRRKAAAASAGTATDGPGGSGGSGPDADLLDDDEEESWTFVGGDADTIDDLSVEAAMKRTVPDLGAVLGGEVPVVGGAPGVKGVKGAGLE

SEQ ID NO: 7632 - protein, 608 aa, Avena sativa
MADAEPTGGGGKGAEDIGGAAEAHSRDSPASAALPTAPSTSSSSADNGNLHRSSTMPGVIKDAEIITETTGPSNFERSKTERRRQNNDPAKQLLDDKISVRKKLKMLNRIATVRDDGTVVVDVPSSLDLAPLDVGGEDGYGDVTVEESLDGADIPSIPPMQIVILIVGTRGDVQPFVAIAKRLQDYGHRVRLATHANYKEFVLTAGLEFFPLGGDPKLLAEYMVKNKGFLPSGPSEIPIQRKQMKEIIFSLLPACKDPDPDTGIPFKVDAIIANPPAYGHTHVAEALKVPIHIFFTMPWTPTSEFPHPLSRVKTSAGYRLSYQIVDSMIWLGIRDMINEFRKKKLKLRPVTYLSGSQGSGSDIPHGYIWSPHLVPKPKDWGPKIDVVGFCFLDLASDYEPPEELVKWLEAGDKPIYVGFGSLPVQDPTKMTETIIQALEMTGQRGIINKGWGGLGTLAEPKDSIYVLDNCPHDWLFLQCKAVVHHGGAGTTAAGLKAACPTTIVPFFGDQQFWGDRVHARGVGPVPIPVEQFNLQKLVDAMKFMLEPEVKEKAVELAKAMESEDGVTGAVRAFLKHLPSSKEDENSPPPTPHGFLEFLGPVSKCLGCS

SEQ ID NO: 7633 - protein, 1449 aa, Blumeria graminis
MEPDEESNEELAHRLAKHHGAHQTNDIPERFQDGDDANEDCTALSAANSYMNQSVFGMIAAAGSQIDFNARFDAHSSDDNEEDTPRQSAEHQIDEMRANTVPTKSGKEKSSNFCRHIVHPSHKPVAKSKSGPPTIAVDNISLHEPTSLPVQIQSRTCTTQSMVMSRMLKARENMSLQPTTNPPHAVGENAESEKHEEESISNSLSKKLMEIFQFETPEQVIEEFPCWLMKSALLQGYMYITTKHISFYAYLPKRSNEVVKSGYLSKSGRRNPKYNRYWFRLKGDVLSYYIDPSDLYFPRGNIDLRYGISATLHTKENSKNATSLTLVTHQREYKFKADSSPSAKEWVKALQKIIFRSHNEGDSVKISIPIENIMDIEESHVIEFADTCKIRVVDNDDTYAVDEYFFSFFSFGKEALNLLRGIVEDTAAQHIPKELLKLSCHGKVDASEPLELTKRDQIPVSAEYVSKEPSSILTTTAPLLEDSVRATLSPLGVPNPVDNSLAGRCSLESHRKSIELKNLRRRSADIIRQKIDGNKKRSMSTGRKSMCENCIAGHIICDEQIDAGQPNIKEKEKVTEEVNVTEKQCLFDSYYHPLEEPSSTSLSNSDNTYASGSQILRGTDVFLTPTIQHATSEAGHCRKGKELELANLSSTKIHVNPHITAQKIHDNAELLEKPGSDRTEPLVSTQTLHSIVKVGAYPLQRAAGLAGYLNRHSKRMSNLLATESMGYVEKVSGMWKGGRKHYDDPRSLGPDDHFDDGEEDDVIYSSERFRKHFALPENEKLQATYFGFLNRVLPLYGKIYISDRSFCFRSLLPATSTKLILPLKDIENVDKEKGFRFGYSGLVIVIKAHEELFFEFSHSDTRDDCAITLLQNLETLRYLKQSGLLTLEEKERAEDAIAENKALQQARSRGHGYFGLESAQNIKCLQNVSPPVIFDDPRSSILDFKPPESLRITCLTIGSRGDVQPYIALCKGLIFEGHQPTIATHLEFKDWVESHGIKFKPVSGDPAELMRICIENGMFTYSFLKEASSKFRGWIDELLTSAWDACQSSDILIESPSAMGGIHIAEALGIPYFRAFTMPWTRTRAYPHAFAVPEHKMGGAYNYISYVMFDNVFWKAISGQVNRWRKKELGLHATNLEKMQPNKVPFLYNFSPAVVVPPLDYSDWIRVTGYWFLDEGTDWTPPKELTEFISKARKDGKKLVYIGFGSIIVQDSIALMNTITKSVEKADVRCILSRGWSDRLQKDTRKVEPPLPSSILKITSAPHDWLFRQIDAAAHHGGAGTTGASLRAGIPTIVKPFFGDQYFFGSRVEDLGVGIIIKKLNISVFSRALWLACNDERMIFKAKILGKTIRKEDGVSTAIQSIYRDLEYARSLIKLRDDKIDPDDIEDVEESWTFIGEDNDPDLVRRVQDWESMTMTGTSPWRERNEDDSDGSFIRKELEVVIGATVLAS

SEQ ID NO: 7634 - protein, 1396 aa, Aspergillus nidulans
MRPFIDDAKRRAERRLSASRQSISARRMFASSFPDRLKVDADDAQMDYTAPPSSNDSRDGMQYMQQSVMSLIAAVGSRTDLRARFDDSSDSEEETRTRPRFLSEKPFDQQITASPRADVTLHVPSAPETRSSSRERGRRHRRSISEHKLFRPFKAGSASQDKKQDASPDPGPSTSDRLSPIPVLPRPRSATPRAAPILSRMVEARALLETENPEENPQTLEEKEQGVSKKSQVSPLSRQLMEMFRFPTPEKVVVEYACSLLQSMLLQGYMYVTEGHICFYAYLPRQSTRVIKSGYIYKRGRKNPKYNRYWFSLKEDVLSYYADPSNLYFPSGQIDLRYGISASLTEPKDKSRESRDFQVTTDHRTYYFRADSSVNAKEWVRALQKVIFRTHNEGESIKVAFPIENILDVEESPMVEFAQTFKIRVVESEETYAIDEHYFTFFDPDSGRRAFDLLKGLISGTPTRSPPGLSPLPDHTAQPRRSRGSQNRWSLTSGSKSQVVSTRRQRSASTSILGSGTGNENSPQRQEDSSSSFFNSIDQVTESSAVLQSITDTTESASQILNRSDVFQSPTIHTWQQRTSGTARSNRRHSDEITRSTTEHGLDGISLARDGPEMQYTNSDSEQESKDASRLYSAVALNEIVKAGTYPLQRAAGLAGYLKSRSKEMSNLLATESMGYIEKVSGMWAGGRRHYGETDGLLPDDRALYPETAEESLRDRERFRAHFALPPTEKLEAAYFAYLHRALPLYGKIYISQNRLCFRSLLPGTRTKMILPLHDIENVEKEKGFQFGYHGLVVVIRGHEELFFEFNAADARDDCAVTLHQRLESAKFLVESISLSQQETDESEAAKVEHRMLQEARRNASAEQDLRPGLSESSELHSIFDDPRASIVNFKPAEPLKITCLTIGSRGDVQPYIALCKGLLAEGHKPKIATHAEFEPWVRKHGIDFAPVDGDPAELMRLCVENGMFTYSFLKEATAKFRGWIDDLLSSAWRACQDSDLLIESPSAMAGIHIAEALRIPYFRGFTMPWSRTRAYPHAFAVPESRLGGAYNYITYVMFENVFWRAIAGQVNRWRMKELGLRATNLDKMQPNKVPFLYNFSPSVVPPPLDFPDWVRITGYWFLSESSDWTPPRALAEFIQCARQDGKKIVYIGFGSIVVSDPSALTRTVVESVQKADVRCILSKGWSARLGDPTSTKVEIPLPPEIHQIQSAPHDWLFSQIDAAAHHGGAGTTGASLRAGVPTIIKPFFGDQFFFGNRVEDLGVGICMKKLNVSVFSRALWTATHDERMIVRAKQLGERIRSEDGVATAIQAIYRDLEYATTLTRQRSSISSTPFSPTPSTKTSDDQNANDDIADIEDWTFIGDESDLEFPRRARERAVSGADNIPERTILGSRSIYADS

SEQ ID NO: 7635 - protein, 803 aa, Fusarium fujikuroi
MSKSRSQSPSKGKEAQDTDNVLDIPWDAPPPYELHSSGSVLASTSRVNDYGKVDIEFSSLQPDEVNRLLPPDKAQEIEPSSSFSTAAPSGPCPALNVVIQVVGSRGDVQPFIALGVALQRYGHRVRLATHDTFTDFVRSSGLEFYPVGGDPEDLMAYMVKNPGLIPSMESLRGGDIGRKRVMIHDMLRGFWSSCVKPDPVSNRPFVADAIIANPPSFAHVHCAQALGIPLHMMFTMPWTATKSFPHPLANIQSQNMDPRASNYLSYGVVDLMTWQGLGDVINAWRVKDLHLDPLAAAVGPDIVGLMKVPYTYCWSPALVPKPSDWGESIDICGFFMRDEPAYTPPQDLADFLARGPPPVYIGFGSIVIDDPTALTNIIKESCRVAGARVIISRGWSKLGGNDPSTNSVFYLGDCPHEWLFKRVAAVVHHGGAGTTACGLVNGRPTTIVPFFGDQPFWGSVVASNGAGPSPIAYKSISVDKLSSAIKFCLSPEAQAAANRIATQMREESGVNTAVDSFHRHLPVANLTCDLIPHNAAKWQYIGRSKKGDKGHIRLSNAALKVLLDAKKAKLADFEPLRPKGYLVENERWDPVTAGASSVLGTMTDFTSALGGAFIDPFKDVKRVRPDGTRRSAGTATAVASGKALQGMTTAVVKGSLVDVPLAFAEGFRNTPRLYGEKVADYGPVTDWKSGGTVAAKNFGFGFYEGLTDIVTKPMKGAKEEGALGFFKGVGKGSLNMVAKPGSATFGLLAYPAQGIYKSIQSMKTNKARDAVTAGRVESLSDGEQGATSPDAPQVVKRFQELIG

SEQ ID NO: 7636 - protein, 418 aa, Unknown
  Description of Unknown: Mycobacterium sp. VKM Ac-1817D sequence
MSTIAIVAIGSRGDVAPLTGVGLRLQQAGHRVIMVAYQAFADLVTGCGLEFRGVADDLADAPADLADISPRQAAKAMAAFLSPRGMQVLGDRVLAAVRDDPVDLLLLSPFAELVGHPLADALAVPRIGVRLQPISATADHPPALLGAWTAGRYGNRVAARVSEALVDALYGKAVNHFRAQLGLPAADARSLRRRRTEAGWPILYGYSPAVLPRPADWRSGIEVVGYWWPARHADWHPPIELVRFLEAGPPPVVIGFGSTVNSLAAAEKMSAAVMQAVRTAGTRAVIQAGWAGLDAGGDDVITVGDVPHDWLFTRAAAVVHHCGAGTTAAGLRAGVPTVAVPAGYGDQPFWARRLFELGVSPQPLRQSHLDPKSLGVAIRTVLSNNRFRDNAEVLSTQIDAEDGAGQVVSTVEKVLSYR

SEQ ID NO: 7637 - protein, 1525 aa, Dentipellis fragilis
MASPWFSKPAQASPPLLLMSNRPPKSQSISPQSPPPLSRPLSPEAIVSDSERPVPPSSPRQIVRRVMERTSEKLGRSKSPGTKPSDLSRSEAVPAGRRFLTSRSKGKSRQNAPDVGSGDEYGIAQHRAQMSISQLSATSVRSEPNVESPFICPPSPSQHPTRPTLNSFQGETSMRAGTQTLIQALQALPWAEDQDNDDDVINHGGLSPAESDSEEEGKQVHGLSSSIHTIYRPVARSRRADSLYRLSPVRDGPEDQPNTQLFTDAAQRDFVSDEEIDDDFEIQTPGRTGSPTQLSLKEDDEHDVSTTPTIEPASLRRHPERIGSLATVKTVKLDRRARLAEKLAEIFELQGITEVVSEMPCWLLRSILLQGYMYLTNSYLCFFAHMPAREDQVLKSGTMYKKAQRTKRWIRHWFILKNDVLSWYQSSSDPYFPHGVVDLRYAISCDPSQEKDIRLRTNNKTIHLSAESVPSRDEWIKAIRKVIFKAQNMGDSVKIAIPYSTILDVERSHAMDFSETIEVKVVDGEEDLAVDSYFFAYFHDLPAALEQIRDAVAAARRFIPNDAATLPQELRIDTTLNPSSAFSRHINSERLPAVQESAPSRLAPFRLSTLLRPFQDSLPIGRTASAPDHLDDRNEDFVAVQKRADSSFIPTTTSPGALDGSVSDSLSPPSTASTLPLDQDSPTARNEITPTPTNLGHTYPPSTTTSVPELPVVPTRESTSSWNVGVPSWLKSVPSPRRVFGSSSSAPSGLDRMAIPADGKTVSEVYSSTLSTSTGKSSNGPNELGYSILETPGTSMDEDATEKFQSAFAFDDKERLLGYFPGYLFRMLPVYGRLYISKNHLSFKSSTPLASKTRMILPLRDVLSTETSKAFRFGHYGLVVIIKGHEELFFEFNQEDRRAAVVRLLENQMEDIRKHKVHSDASAPTKGQRDALVLEEFGPKIAAAEDTDPRPPPESLTDSVPAIMFTSTSSTFLTFKPKESLHFTFLTIGSRGDVQPYVALAKGLMADGHRVKIATHGEFQNWVESHGIEFGYVGGDPAELMRICVENGTFTVSFLREGLQKFRGWIDDLLKTSWEACQGTDVLIESPSAMAGYHIAEALRIPFFRAFTMTWTRTRAYPHAFAVPEHKMGGSYNYMTYVMFDQVFWRGTAGQINRWRRNTLRLPSTSLDKMEPHKIPFLYNFSPIVVPPPLDWPEWIRVTGYWFLNDADVSATKWTPPADLIEFIDTARKANKKVVYIGFGSIVVSDPKGMTRCVIDAIVRSGVHAILSKGWSDRLTKNASEASEPEEPLPKQIYQISSVPHDWLFQRIDAACHHGGAGTTGASLRAGIPTVIRPFFGDQFFWADRVEALGVGSGVRKLTVESLADALVAATTDTKQIYMAKFVGEHIRSENGVATAIEAIYRDMEYARSLIKRPTDDELSDELVEPEEATIREDDKPVSSPPSRPETRSGSSSAGGAASEDWSVVSDLDEPNSRPSRRASEGRDRAQSWRRSGITAAVLSMLPDTLTTGGHRRSRSTSSVSARNV

SEQ ID NO: 7638 - protein, 433 aa, Martelella mediterranea
MTPRKVLICTYGTRGDVEPFLALAHGLKEAGFDVALATSSRFRAFVESHGVAFFPMSDTSLAALESPDGKTMLEGDSGLLPRITAGIRLSRRSGAIQDGLMRETFAAAIDFPPDLIVFNAKLFAAPHVAEKLGVPAFLGMLQPMLVPTAAFPAMGLPNLPLPGYNRFTYVLVRKSIGSFRRRMNRFRHEVLDLPPVRNGSAVLFPPGAGNIGVLHAYSSGVLPRPRDWPESARVTGYWRLDDGRGYTPPPDLAAFLDRGEPPVFIGFGSMPSGDARALARLAAAALRKAGRRGVIAKGWAGLDVEGSDDIIAIPPVPYAWLFPRMAAVVHHGGAGTTAEGLHAGVPCVICPFFGDQRGWAQLSAALGVGVAPLPRRRLTEDSLAAAIAEAVTNTLLRDNAENLAARLRRENGVKTAVEIITQTLSDPRRGETV

SEQ ID NO: 7639 - protein, 865 aa, Cordyceps militaris
MFRTKSTEPGQLVLEQGPSGSVLDDGRFKIRFHSEAHSLASWYHDLQMKRSCKHPASRPTSPEAPKADPAGFPPLNIAIHIVGSRGDVQPFIPIAQILSAAPFNHRVRICTHPVFKDFVEEQGVEFFSIGGDPEALMSYMVRNPGLLPNRESVKAGDIGKRRDEMAEIINGCWRSCIEAGNGMGEPVTAAFVTDPKELFIADVIIANPPSMAHIHCAEKLGIPLHMVFTMPWSPTDAFAHPLAAMNYGGADKKMANYISFIMMELLTWQGLGDLISKFRHQKLGLDPISPLWGFHLLPRLRVPFTYLWSKSLIPKPKDWGNYINITGFSFLPLASSYTPPDDLTAFLAAGPAPIYIGFGSIVVKNPAELSKLLFAAVKKAGVRAIISKGWSKVGGDDVPDNIYLIGNCPHDWLFQHVSAVVHHGGAGTTAAGIAAGRPTVVVPFFGDQAFWGRMVARAGAGPEPVPFTEMTVDSLAKSITTALTDDVQKGAQEMAKTIAAENGAEDTVTDFLERLASEDKLQCDLCPGRLAIWLHKKTGARLSGFAAACLADKGIMTPDQAKLIHHKSWYVDEGAEHPLVGMVASATGFVTAVAIASSDYSKAWKYRPSKASAKKETASESSSERKGAVPEDKPPANGAAHIMTPSQMEISAKKMATKSLRTVWTPQPRIERTPTFHDNCKAEWEGHERGRHGRTWYLARKTSRFGVELTKAGLKAPVAFFWNTANGFHNFPSYGYAGIEVRRRDEVKGFGSGVKVAGKEFVLGFWDAFSGIVVLPYKGTRDEGAKGLGKGIWRGGKGFFCGLGAAVFGLPGYTLKGFERELSKRHLTKLKAEILLIRLRKSLQDFREATVEEREAVIDAWMAKY

SEQ ID NO: 7640 - protein, 1166 aa, Schizophyllum commune
MATVRVQRRNRLASKLKEVFELEGIDEVVAEMPCWLLRSVLLQGYMYLTNSYLCFFAHMPSREDQVLKSGLLHKKSQRTKRWIKHWFVLKNDALSWFNSSSDPYFPHGIVDLRYAISCEPVGEKEFRVRTNQKVVHLQADSVPSRDEWVKAVRKVIFKAQNMGDSVKIAIPYSAILDVEKSSAMDFSETIEVKVVDKDDSYSVDSYFFAYFHDLPAALDQIRDAVRVYRSLPEPPSPYSVMDTTAGTRTPVAPQAMDRAVSAPASDTASRTLSAFRLPSLFRTVPSTPEKANFSSPDVTDNEEFTHISRRPNSFVPITASPKQMTSSELPSEAATPTQSTIEHTYPPSTSSSSTQPDSSLHSATSGGSGWTVGVPSWLKGRPRLLGGGIPRVKEMYTPPTTTPSAGSGSSMGDMAFSVLETPEATLDVETTEKFRAAFAYDEKEMLLGYFPGFLFRLLPINGRLYISTNFFCFKSSGPLATRTRVSIRLLTYLQMAIPIRDILATEKSKGTRFGHHGVIVIIKGHEELFFEFWGEDKRDSFMRLLGKQMEDVHRRLASGESNNVPSQGNRDALILEEFEPPSADDPDAPAPDTSMTDSLPAVMFTSASSTFLTFKPNKSMHFTCLTIGSRGDVQPYIALAKGLMADGHRVRIATHVEFKDWIESHGIEYGYVGGDPAELMRICVENGMFTVSFLKEGLQKFRGWLDDLLKTSWDACQGTDVLIESPSAMGGLHIAEALRIPYFRAFTMTWTRTRAYPHAFAVPERKMGGGYNYMSYVMFDQVFWRAIAGQVNRWRRKSLNLDSTNLDRMEPHKIPFLYNFSPTVVPPPLDWPEWIRITGYWFLDDADASGKKWSPPDSLNKFIHKARKEHKKIVYIGFGSIVVSDPKAMTRCVIEAVVNSGVRAILSKGWSDRLSVKTTEASDIEEPLPSSIYPIASIPHDWLFQRIDAACHHGGAGTTGASLRAGIPTIIHPFFGDQFFWADRVEALGVGSGVRRLTVESLTDALRAATTDVKQIEKAKAVGEKIRSEDGVATAIESIYRDLEYARSLIKAPPSQPRPLPPHDDSDEDLVLENSTIRDSVTTNNSEHNSGYNSSSGGGAPSEDWSMVSADGEERRPSTSGSRPPVQRRCSSTDRIVNKRNSIAAAMLAVLPDSLASPRRAASPGA

SEQ ID NO: 7641 - protein, 1495 aa, Phialophora americana
MSNHDSPTSKKGGLVRRLSKRPHNLNRLPSSHIPSRLRLGDDAQDDVTAPNRGRNVPASYMNQSIFSMIAAAGSRTDFNTRFDESSDSEEEIPEEEQEQTVGDDTSQPVAVDVRGKVATTDGRPTSDSKIKRLSSHHLVQSLPRLSVRSTKKKEKGVAQQEQSPESDVTSKSSRSNPREAPVLSRLITAEAAFQESAEADEQPTDSPDVHKSRSRGESTPQTLLATRLMEIFGFESPETVVAEYPCWLLQSVLLQGFLYITKQHICFYAYLPRKSNTVARTGYLSKKGRTNSKYKRYWFSLKGDVLSYYSDASNLYFPSGNIDLRYGISAALSTDKEKSKQKECKEFSVTTDHRTYHFRADTATSAKEWVQSLQKTIFRSHNDGDSVKISLPVDNIIDFEESPVVEFAETVKIRVIESEDSYAIDEYFFSFFSFGQDALNVLGSLLTEAPGRRESDDILSPARKADPLSSPRSRPTPIRQSSDISTGSARAQSSPPLKDSVRATLLPYTIGDNGRMSPRMSGEFARGNSPSRSSNDFTGEYGRASFERGRRSGSTSRLEINKSKRSGRSPLARHHDSEDSYVQSIDKETDSSTAPLSPRAEAQMSASQILTRSDVFHTPAIHRMDTLASMSTEPSRKSSDAGTMRSGSPQRGQISPIPSRPLPDHQQGRRPTVQTEALLLTEMQSDQKMLRNDSSPTLQDLVKAGSYPLQRAGAFADYLKNRSSSMRKLLATESMSYLEKVSGMWAGNRKHYGENEGVVSEDRGVDPEDEEANVGHGDRFRAHFALPATEKLQATYFGFLHRVLPLYGKIYISNRKFCFRSLLPGTRTKLVLPLRDIENVDKEKGFRFGYHGLVLVIRGHEELFFEFSSAEHRDDCTVTLLHSLETARYMAESGVLASHDDDDAEIAKEEHRKLQEARRSSAAGGEHALVLPDTAEAIYSHKHEESSPSPSRASGRLLFDIDPRASILNLSKPTSSLRVTCLTIGSRGDVQPYIALCKGLLAEGHQPRIATHAEFEPWIRKHGIDFRPVDGDPAELMRICVENGMFTYSFLREASTKFRTWIDELLTSAWSACQDSDLLIESPSAMAGIHIAEALGIPYFRAFTMPWTRTRAYPHAFAVPEHKIGGAYNYYSYVMFDNVFWKAIAGQVNRWRKKELGLRSTNLDKMQPNKVPFLYNFSPMVVPPPLDYSDWVRVTGYWFLDEASDWTPPADLTNFIKKAREDGKKLVYIGFGSIVVSDPAALTKTVVDSVLKADVRCILSKGWSDRLGNPDAVKAEVPLPEDIIQIKSAPHDWLFRQIDAACHHGGAGTTGASLRAGLPTVVKPFFGDQFFFGSRVEDLGVGICLKKVNVSLFSRALWEATHSERMIVKARLLGETIRKENGVQTAIRAIYRDLEYAKSLVKARAAIQQQGAVTAAGAAGLTAVDLLDEGGDIEESWTFIGDASDPELQRRIQEWDTTGSGATTVRGRAPRVSIDLAKLGAMQDVEPVRKGSVKR

SEQ ID NO: 7642 - protein, 1269 aa, Lachancea thermotolerans
MPGEKPDTDEISEVEQRPATVVESPKRRWRRSMPPVGRMYQSFTSFASSNRNSSDGGSSNPVFSDEDSSGPHGGEDKDQEHDLAIPCGMAKSIVGLLTTASVYAGMGDIEQAESICEGEESDASDDSGPTDRSEAFERSEPSKNPGTPEVNKDDEVEGPASSSPSDVTVGADENSEANDSNPISETPSQISKKDTLFEISVVPNSDLQSIMTSSSNSRQSKIYRKLISKFGLNEDEDQFVLTCPCWLLKDLLIQGHTVLTTRHLLFFAFLPKSTGATKMSGNLSTVSGRLRGRWTRHWAVLKDHTLSFYNSPKDLYFPILTIDLRYATKVELSKHNGEATGDFRIFTEGKTFKFRADSNYAARSWCSALKKQVFATQNSENDSMSVKIPLANIIDMDEQLVVAQSVTLRIRVLESSQSFAVDDYFFMFLNKKDLKLKETINTLLLELDRVSPEELGSTTIANETGESPLVDEDTQKGSHPERRGRSRSTSKKLFKRVLSPMSRSPGHSLSMSISIPFSTKSSHTGKGRLRAVTDGFSRKLPTGNVEEHVSVKHPADIEVEPSNEDQEVVPKETAANESVPDPADEGKGRNFRLASWTPKPIKNMGNMWNAHPVHYETEGPDMFPGDDPYLTTPKEQSIAAKRFRSHFSLDGTESLHAAYYTYLNKNIPVYGKLYLGASVVCFRSLIPGTKTKMILPIKDVENCYKERGFRFGYFGLVLVIHGHEELFFEFSLQSSRDDAEFAMLKLLDAVKPRLDGVSAAKTNVKNGNTESSSGRNKQLTEAAKLRMLEDKINAEGYDLPMMIEENPYFKTSITPKKSYKFGLLTIGSRGDVQPYIALGKGLVREGHHVTIITHAEFGEWIESYGLGFIEIAGNPAALMSLMVQHGSMNVGLLRDASSQFRGWIKDLLDTSWSACQGLDILIESPSAMAGIHIAEALKIPYFRAFTMPWTRTRSYPHAFIVPDQKRGGNYNYFTHVLFENILWKGIGGQVNKWRVEKLGLEKTNLYMMQQNKVPFLYNISPSIFPPSVDFSEWVKVTGYWFLDSKDDYDPPVELVKFIEKARASNKKLVYIGFGSIVINDPKEMTRAVVDAILDADVFCILNKGWSDRLDNDIKKNAEQEVFPDCIYNSGSVPHDWLFPKVDAAVHHGGSGTTGATLRAGLPTVIKPFFGDQFFFAGRIEDIGAGISLKKLNSKSLSRALKEVTTNSRIINKAKQIQQEISKEDGVSVAISCIYAELAYARSLVVAKAKGTQSDAKDPSSPEENTWFLV

SEQ ID NO: 7643 - protein, 1519 aa, Sphaerulina musiva
MASSGKQHDIAASQPALLPIRSGARATSSIKNISSRVRSSLPRRRLSMDLPERLRFDEAEEEDVDDGTGVKDGFPARSMYGMLAAAQSRPNFKKQFTQQESASDSEGEDDKHKRRSVDQRRPSKEISRDADKGRKPSEEGRTSPRPEESSKRHKARLSVNRLARSVLSKHELKPTTKQTESQEQDAMTSSQILPPRVQETTSEARATFVRPDATVLDRKLKAMAQAELDASTSTLTSRKSREEGKAFGEVESDKTNHSLAHVIADIFQFAEPEEVTSEFQCWYLQNVLLQGFMYITTKHVCFYAYLQKKTTKTVKSGHLGKLGKHSYRYRRYWFVLRGDSFSYYNSSAEPYFPNNVVDLRYAISAELAAVPGKEETASDFTITTPSRVYQYRADMVSSAKDWVKQLQKVIFRTHNDGDSVKISLPIDSIMDVERTGVVDFAETIKLRVVDNEETFAIDEYFFTFFHHGEDAVKALIALAAGNGAKKLRIEGAISPLSKHRSPAGRKMSSAEQSPRLSTIKSTLLPASAAERSVSRSSGERRRLERRASSDHGVDVSDRGRTSASAQGRDSRNASKSPMSPSIHASSESFVTSSEPPDSSVDGDAMDADMSASQMLSDDHVFRGPTLRTSQARRTAAGQPAGRPRQVSRASSRDSSGERDSIARVQAPSWPATYRSMGNQRPTPQRTESGDSARTAEPDDRPRPEPSGPKLIRGISTPLQHAMNVAGAVRAGSKRVGSYLSSSPKTYITNWTEAMAGGKRHYTDIEGLAHDEGVREPERHLDYAEHERRFQEHFGLPPTEKLVSVFYCWLHKTVPLWGKIYMGTRRLCFRSLYYGTSTKLIIPYKDILNVQKQRGFRWGYPGMVLVIRGYEELFFDFQDTGLRDDCVVSTLRTVEVVEAAAESMILTEVEQQDASEAAAENALLRAARQTGHDDEEGISLPEEVDALPVIFDDPSASVLEFRPKKSLNITCLTIGSRGDVQPYIALCKGLLAEGHKPTIATHAEFRGWVEKHGIAFKEVDGDPAELMRICVENGMFTPSFFLEANSKFRSWLDELLVSSWAACQGADLIIESPSAMSGIHIAEALEVPYFRAFTMPWTRTRAYPHAFAVPSQKRGGGYNYMTYIFFDNMFFAAIAGQINRWRGKTLKLGPTSLDRLQQNKVPFLYNFSPSVVPQPLDFSDWIKVTGYWFLDEGEDYVPPAELAAFIKKARDDEQKLVYIGFGSVTVSDSRQLMQQIVDAVVKADVRCILSKGWSDRFETAVAASQPALVLPSCMYEIRAAPHDWLFKQVDAVVHHGGAGTTGASLRCGVPTIIKPFFGDQFFFATRVEDLGVGQHLKKVTGNQLGRALWYATHDERMRSKARLLGEAIRSEKGVDTAIKAIYRDMEYAKSLIKKKKQQQAHGATTSTSSDGANASIDLSEDTEENWTFVEMEGEAAAAAAAAAAAAAETEAFGALAAELGGGGAESCLPRSSSKALHGQRSHSSSFRSSSSSSSSSSSAAAIASGQHSRAGGVAVRGGRS

SEQ ID NO: 7644 - protein, 737 aa, Colletotrichum incanum
MSVIESKRSRRTDDEDSESLCETPPPYELHSSGAFNPVKRRYQVGLSACADGNLTISFQSDRPQQLAEQLPPFPTTEDTTLARINVKTVPSLNIVIQVVGSRGDVQPFIALGTSLRRYGHRLEFFPIGGDPADLMSYMARNPGLVPSVESLKGGDVGRKRRMMREVLHGCWRSCINPDPVGNQPFVADAIIANPPSFAHIHCAQAFGVPVHIMFTMPWTATRAFPHPLANIQRLGDVINSWRRRDLALAPIPASMGPGITTFLKIPHTYCWSPAVVPKPADWGPEIDVCGFFIRDKPAYEPPADLDAFLSAGPPPVYVGFGSIVVNHSTRLVGIVLEAASICGVCLLILRGWSKLDEGRPNTDDVFYLGDCPHEWLFKRALAVVHHGGAGTTACGLINARPTIVVPFFGDQPFWGRVVAKAGAGPAPIPQKELDVGIMVEAIRFCLSPAANHAVQAVAQTMRQEQGVDTAVVSFHRSIPVNVMCCDILPDQPAGWTRQELKSADLKVLRTKEYDTDVKRWDPITGGASSFLGTVTDFTFVLGGTFIDPWKEYKRARISAQEAGRASGAAAMAVGKGFASMTGAIAKGGLVDLPLAVAEGLHNVPRLYGDRPREHGKVEDWKSGGIAAAKTFGTGFYDGLTGIFTDPYKGAKEGEALGLAKGVATGSVGFVIKPGAALFGLVAYPAQGIHKSLKARIGRSHAVWTAKSALLDHDQRQHSGIPRGGSKVLQVFDAYFTQ

SEQ ID NO: 7645 - protein, 690 aa, Citrus unshiu
MRSNGFDHPLKDVDKEEGVGGSKTLNKDLGQTDGIDEPMNKYNARAFQSLEKQKTNSLEQSPVVGISLSKKEDVHSSPRASLDHCITAPITRRDSLTDMNEFRYSRSMTEKKSMPRHDLKLDRLSDREKKKLIVELVRIQNDGTVEVDLDKSAPVASEFLEFQPVEGPPIILDDTSFSDSKKSIPRLNIAILVVGTRGDEFGHRVRLATHANFRTFVRSAGVDFFPLGGDPRVLAGYMARNKGLIPSGPGEISIQRKQIKAIIESLLPACTDPDIETGVPFRSQAIIANPPAYGHAHVAEALGVPIHIFFTMPWTPTYEFPHPLARVPQSAGYWLSYIIVDLLIWWGIRSYINDFRKRKLKLPPIAYFSTYHGSISHLPTAYMWSPHLVPKPSDWGSLVDVVGYCLLNLGSKYQPQENFVQWIQRGPEPIYIGFGSMFLVIVGGHQANKLHFDDLVGGFHIPVRPLEDPKKTTEIILEALRDTGQRGIIDRGWGDLGKITEVPDNIFLLEDCPHDWLFPQCSAVVHHGGAGTTATGLKAGCPTTVVPFFGDQFFWGDRVQQKGLGPAPIPISQLTVENLSNAVRFMLQPEVILELAFLFQNLKSDTHQRLQRFWFLTGLWLSQVKSRAMELAKLIENEDGVAAAVDAFHRHLPDEIPMPSALPEKDDGPDPLQWFFIQIGNWCCQRCGGV

SEQ ID NO: 7646 - protein, 867 aa, Aureobasidium melanogenum
MKATSANHSTLDHEDPSPPYESVAPNVPDALSVGMRNDGRMDMDIDEALGRQLTTLVQEEETTSSPHRGALSIRETIPIVKCPAKLDICIQVVGSRGDVQPFVALACELHQQHGHRVRIATHAVFEDFVRESGLEFYPIGGDPAELMAYIVKNPGLIPSVASLRAGDIGRKRRMLAEILEGCWSSCYKPDEKTQRPFVADAIIANPPSFGHVHCAQALGIPLHIMFTMPWTSTRAFAHPLANLKYSPDTSPRVANMMSYGVVEWMTWQGIGDLINDWRTRILDLEPLPSSEGPLLLETLNIPHTYCWSPALVPRPSDWPEHIDVSGFFFRETPPYRPPPDLRQFLEAGSQPIYIGFGSIVIQDSEALTKMILEAVRMTGVRALISRGWSNLGQDRKSDDTVFFVDDCPHEWLFDHVAAVIHHGGAGTTACGLSKGVPSFLVPFFGDQPFWGTMVAASGAGPEPAPHQSLSALVLARGITTCLLPGTKQAAMEVAGKMSTEAGVHAAVQSFHAQLRVDLKCDVIKDEPAAWKYQDGSNLIKLSKRAAAILTRQAMLNPKNLTHYASKPIIIDAKRWEPVSAVVSASLHTAGSIGRAAAGVVLEPYRLYKSTKARSDLSDAHAGPSRATQRAENETQPSAEQADTVSSDKKKVPSTHLTATAPRKNEDQRAIMSDSSDSTNRTREIMKVSAKNAGKFFFSPIKGIVLDIPLAAVEGMWALPRLHDDNGYQHTAVKDWKSGGSVAAKSFVHGIHEGMTDIFIKTYAGKKNEGAKGVAKGLSMGFVNLTMKTGAGALGLIAYPCQGVYKSIHAAMHTKARNAVEQAKLDEGEWLMNNQPMADVEIQDVVQRFLHATPVKGNGKSKVGVWGR

SEQ ID NO: 7647 - protein, 726 aa, Fusarium fujikuroi
MFATESLGYVEKVHGMWKGEHRHYDEPQELKTDDDGDDIDSDAEDKTQTAMDRFRAHFTLPESEKLIATYFGAIFKVLPLYGKFYISDRSFCFRSLYPGTRTKLILPLKDIENVHKEKGFRFGYYGLTVVIRGHEELFFEFRRPGLRDDCAVTLHQLMETNRFLEKSGFLDQEEQDDEEAAAAIAERDALKAARQDEFVNHELELPRETSGVSNAPTILFDNPNSSGLAFKPQKSMKITCLTIGSRGDVQPYIALCKGLIAEGHKPRIATHAEFQGWIESHGIEFARVEGDPGELMRLCIENGTFTWAFLREANSTFRGWLDELLDSAYTACEGSELLIESPSAMAGIHIAEKLGIPYFRAFTMPWTRTRAYPHAFIMPEHKMGGAYNYMTYVMFDNIFWKATAYQVNRWRRKTLGLPSTNLEKMQPNKVPFLYNFSPSVVAPPLDFSDWIRVTGYWFLNEGGDWEPPQELQDFIAKARADGKKLVYVGFGSIIVKDPAKMTQEVIDAVLKADVRCILSKGWSDRISPKDDPSKPRPEEPEMPPEIHVIKSAPHDWLFSQIDAAAHHGGSGTTGASLRAGIPTIIRPFFGDQFFFATRVEDLGVGVWVKKWGTNSFGRALWEVTRNERMIVKARVLGEQIRSESGVDSAIQCIYRDLEYAKSLIKRNAGKAAQHDANEDEDTEESWTFVGRDEPDPDAVTKKLSEGLVDTEKPLSLGSQAPSTATA

SEQ ID NO: 7648 - protein, 1771 aa, Wallemia mellicola
MRYTAILLEKSAAQKLLRDAIREESKSSTERKAFRLSDHDSELHSANAWDGDEHPQDTSLRMLLDAKKPLRSGNKGLYGESRLKTIQKPTHTDNLIPSDPSYQTWDATYVAPSHASGSQRPAIYRARNTAEIQALQKVQSMDLDSRTKAHIRNTKKSKAKVRRISNAREGALDYSLTGSLDDVEKTEYTKARPQNIQAWNSHIEDQIQVAQRNGKFSNLPGRGKPLASLNEENAFISRDEQILNRLISRQGAVPPFVEMQMSVERETTSFRNYLREEIVKRALVDLPNYSSDDVVCSYRDQVWEDRNVSYHNILIDRVNSIIKSYNAIAPAFSRRGLLLLETEMKNAREEALPVIINRLRHPRATSKPAKQDKKPSTLIGRIHEQQKSTEESNETESKTNKSEENVEDVVNTSNSAADSNKEYSQSTPPNEILTQQGTTSAFLTPPNSWRGDVNMRMGTQSLIQVIQAFAHHADDDSNDDDEDAQEDTQDHRVFDMYSSLNTVHNKPQTHLHESMSTSMSGTPHESQDEDEEAGSDRSAHSDDSELTRMRSQSLKKKSTQRRRNLSKKLSEIFDLDGQEDIKAEYRCSLLGSSYRPLLEGFLYSTNSFLCFFAHVPTLERNNVVKTGPIGKRTLRTRRVIRYWLALKDDVLSWFGSAIDPYFPVGNVALRYAIRCVTVKNSDREFTIFTSERKFTFLADSKTGRNEWVKVIRKGMFRSQNESGSFKLVIPYDHVINVERSSNLEFADSISVSFINNEDGADCYYFDHFRDSVAESDDEFEEVGSDFSVLEHSAGMEDILKVEEEVQRKFNEYFALPGEKILGHFNCALSFQIWSRTKMILPLSDLQAVQPHKPLRFSFHGLIMIIHRHEELFLEFTTSNRRDACEKLLNTQLDKIFRSASIQQTQSSKGLQEAQIIEDLSLSYRHPSLTAPVLGEEGVSPSTGDVQPYIALCKGLIKEGHHCRIATHLEYKDWIENYGIEHREVGGDPAELMQICVEHGTFTLSFLREGLFKFRSWLDDLLKCSWEACQGSDLLIESPSAMAGIHIAEALQIPYFRAFTMTWTRTRAYPHAFAVPESRMGGSYNWMTYTLFDQVFWRAISGQVNRWRRSTLGLTGTNLQRLAQHKVPFLYCISPTLVPKPLDWNEWIHVTGYWFLDSITPENSENSENSVNDNNGKWDAPAGLLEFIAQGRSLNKKIVYIGFGSIVVSDPDEMTKCVVEAISQADVYAVLSKGWSDRMHTGKKEEKLLFPPSIFSIDTIDHAKLFPMIDAAVHHGGSGTTGASLRAGLPTVIKPFFGDQFFNADRVEATGVGSSVRKLTVETLSKALKTATTDEKQIANAKTVGEKIRNENGVANAIECLYRYMDYASTVITTRAHENLQHDDGIDAQDIEDDDDWSLPSETFSEDEAQRSMGVLSLATNIDLVTAIQIRSGVKIDCCSAATGLTCPEKNPCCSEFGHCGDTVAHCRGGCDPRVSAPNACSNVPICEDLEIKAFDRTAWSRVTQKPEDYDGEADQYDFTLDKGDITREENMLTMIMDEDNKGTRLSSTRYMLYGEFNARMRVTGTNGVISTMILMSDIHDEVDWEFVGAKTGEGQSNYYYQGVTDYTNGDTHKFPTGGQFHDFGFNWQEDKLEWKIDGQVVRTLRKDDTVGWDKKAHYPESPSRLQFSVWPSGIEDVSPGSFEWGGGKIDWSKGPFKATIQSISIKCGQSSEVPIGPDDISWEYNNQTSSQIAFQASPEPYKASSGGSSLHVSSPFTLMLSLSFALLYLVI

SEQ ID NO: 7649 - protein, 1314 aa, Pyronema omphalodes
MLSDDDLDHGRGASVRTQRSQRSHRHPYAGTQSMMLPRRPSIGDASDEDQSDAAAISSKTPYNMNQSLYQLIQQTAAVGLRGGNWRNSHRGRGDSEEEEGGEDGGDGDKGKGKERAASTKPTKAWGSALNRIEEKEMQDIEERGWQKHGPAPYMSQVLEHQKSEFQTAQNSRSDIRDAPERTMDLAKKVMEIFSLPQEEKVEAEYPCMLMSLDSIFLQGHLYITAYHICFYAYLPKRTNVNLKTGYLSKRGKSNVKFTRYWFELKGHVLTYFADPSERYFLNGHIDLRYGIQASLVDGGKDGKESKDPTAFIVTTDQRKLYFRADTVTSAKEWVKAIQKAIFRTRNEGDSVKICIPTSSVMAVEDIPLPGAQKTIRLNVVDSDDTYTIDDYYFGFNEYGTTALRVLQSAVEGSAASRLPDYLRDSTGSMGSCMSRDTSQRENVRATLSPRSPSGSARGSPRVSGEYTRSSFDPTRRNDFGGPLKRKQGHNRVFSNDSTELSYEEAESSRTTDDEDHSQSGSQILSGSDLFHSPTMKLNRLSLSRKKDKQKATPQDKDTSPSATIRIQPPTRQHTHHGDQDSGSEPNSPVGANKTTGIYPIAKATEWAGWMKRRSVKVGSILTSQPMGYLEKVTDMLSGGKTHQQPMGMMPHEKVDDEEQGEGELSPEDHSQRFRNTFAMPENERLCAVYYGYLHRTVPLYGKIYLSERNFCFRCVYPGIKTKMILPLKDIESVKRNKGFRFGYSGMIITIRGHEEIFFEFGQANARNECTNIMMDNLDQLRHMAESGFLSRGEYEDAESAKKEHQMLQEAHGYDNMTNSGYSTASKTSNSPVIFDDTHGSIIDFQPEPMKITCLTIGSRGDVQPFIALCLGLKKDGHSVKIATHAEFRNFVESHGIEFAEVAGDPAELMQLCVEHGMFTPEFLRQTHTTMRSWLDKLLETSWEAVQGSDLLIESPSCMGGVHIAEALHIPYFRAFTMPWTRTRAYPHAFAVPERKMGGAFNYLTYTVIERVFWGATAGQINRWRKNMLGLRSTDLSKMQLSKVPFLYNFSPNVVPPPIDYPDWVRVTGYWFLDNEPGFIPDSELMAFINKARFDGKKIVYVGFGSVTVEDPVAMTRTIVESVHAAGVRCILSKGWSERGKPAGSAPTPHTTEAPADKTAVKDPYSLGPEIFQIVSCPHDWLFKQVDAAVHHGGAGTTGASLRAGLPTIIKPFFGDQFFYATRVEDLGVGVSLRKLNTTVFTKALVEVTTSERIINRAAVLGEKIRAEDGVATAIKHIYRDMDYAHSLVKDKKPDLANELAESDESWTFVGNEQE

SEQ ID NO: 7650 - protein, 1343 aa, Penicillium oxalicum
MKSSPTRRLHSDQWPDRFKDGDDAQVDYTAPPRNMRSKDGHMQYMQQSLFSVLAAVGSRSDFRGRFDDSSGSDGDLEDDKAETRLNLNSGKKATVGGHQAVDPADWKPPGQHGERGRRHQRTKSDNKALRRNPAIENQDTSDDPLAASGATLRIPTRRARSATPRAAPILARMIQAQQTFDSASESKQLPSRSELPNDDSHEPPSSALSSRLMEMFGFEKPEKVLVEYACALLQNMLLQGYMYVTEGHICFYAYLPKKSSSAMKSGFLSKCGRKNPKYNRYWFVLKGDVLTYYANPSNLYFPSGHIDLRYGISASLADIKGQSSEPTDFHVTTDQRTYHLRAESATSAKEWVKSLQQVIFRSRNEGDSVKISFPVDSVIDMEESPMAEFAETFKIRVLDNNETYAIDEYFFTFFNSGQEAFNYLKSLVGSSPMKSLSDGSPHRGNSRHSSQVGVLGKATPAPDSPQGATPIDHQPSQVSSFEPHSEPRDSVDSLDFSTNQGTESLPIFQSLTETNESASQILNRSDVFQSPTMHSLPRRQSDTGDPNRRRGMARQESSGLSGFNTDTDDSRGNQGRADRETGSSPQHALGMPLDKTSKAVPQPVKRAAGIAEYLKSRSKQMSSLLATESMGYIEKVSGMWAGGQKHYDETEEVLSNDPSLDKEDKENGLKHGDRFRAHFGLPSTEHLQATYYAYLTRVLPLYGKIYLSERKICFRSLLPGTRTKMVLPLKDVENVEKEKGFRFGYHGLVVIVRGHEELFFEFNTTDARDDCAVTLHKNLESARYLAESGILAEKERNLTEAAKAEHRRLQEARLENPDEEDTETARNESESEVSPFFDDPLASIINFKPTESLRITCLTIGSRGDVQPYIALCKGLLAEGHKPKIATHAEFEPWIRSHGIDFALVDGDPAELMRICVENGMFTYSFLREATSKFRGWIDDLLSSSWASCQGSDVLIESPSAMAGIHIAEALRIPYFRGFTMPWSRTRAYPHAFAVPETRMGGAYNYITYVMFDTIFWKAIAGQVNRWRNNELGLKATTLDKMQQNKVPFLYNYSPSVVPPPLDYPDWIRITGYWFLNEGSDWTPPTELSAFIERARTDGKKLVYIGFGSIVVSDPAALTRTVIESVQKADVRCILSKGWSDRLGDPSSQKVEIPLPSDIYQIHSAPHDWLFSQIDAAAHHGGAGTTGASLRAGIPTIIKPFFGDQFFFGSRVEDLGVGICMKKLNVSVFARALWEATHSERMIIKARDLGVQIRNENGVATAIQSLYRDMEYAKTLARQRSIASSTPFSPTPSAQASPDHADADVDDIEEWTFVGDEAEMEMTKRMRELNLTDREKTLSEIIH

SEQ ID NO: 7651 - protein, 1445 aa, Pyrenophora teres
MASQDRGRDKISRRTSRKMKESRRESRGMSLDMPERFKDGDDAQEDVAAPKRSNTVSMNQSLFSMIARAGQQSQVDLATMQEADSGESDDDGKPKTAFRGLEGAARLSRLSSANNFQPPAEDTNEGTVDKRKHRRTLSENKLLRSLPKLKLSSRKETRDGQRSDQMSSSQFLPPKPSSTELSTPPSDQSPKTDVKEKPTTGEEIRSEKGKSSGRKSRHGSSAGLAKSKTTVTLAQRVQQIFEFEEVEEVISEYACWLLQSILLQGYMYITQKHICFYAYIPKKHHDVSKTGYLSKRGRSKFNRYWFVLRGDVLAYYTNPAEVYFPRNRINLQYAVSAEVIESTKKGEEETSFAITTDERRYLFKADSVASAKEWTKSIQKVIFRTHNEGNSVKISLPIQNVLEIEESSILDLANTVKVRVIDNDETFAIDEYFFSFFNKGQDALNVLRIMINDNEHHQGDREVATPTGQRDSVVSPTRTGATPHISENVRATLSPLPAPHTGRSSTSEASAHSSADVAGKGRDVRRSMDASRTFQRSSYEVRRPSHEGRRSFSGGTQYAQSKARPGDRSPQSPRVADSESATLSLDPGTESSAAIQSMDESNASASQILDRSDVFRAPNHPPAINKLDHQARNSQETTRSSQLKSPNWGKRDKQPQTPTGIPDFEDDTDNSQAHRLSGSSSALQDIASYPLQKASGLAGFLRTRSKKMGSLLATESMGYYEKVSGMLAGGRKHYNTAEGLETGDQVHVFEDDEDAAKAAENFRDHFAFPETEVLQSSFFASLQRVLPNYGKIYISGRYFCFRSLMPTSKTKIILPMRDIENVNKEKGFRIGYHGLAIVIKGHEELFFEFSKAEYRDECAITVLRILENTKYLEDEDSSSSGVDSEDEAAKAEHDLLQQARELTDSNKHVNVSEIVRVADNDRIPLIFDDPLASFVDFKPSEPLTIVCLTIGSRGDVQPYIALCKALLKEGHKPRIATHAEFEPWVRKHGIDFAVVDGNPAELMKICIDHGMFTYGFMKEANSKFRGWLDDVCSSSWRACQGADVLIESPSTMAGIHIAEALEIPYFRAFTMPWTRTRAYPHAFSVLETKMGGGYNSLTYITFDTIFWAAISGQINRWRRRELGLQGTTQHKMQAALRPFLYNFSPHVVPPPLDWPDWVRVTGYWFLDESDTYEPPTELTAFIQKARTDKKKLVYVGFGSIVIDDPAALTKTVVDSVLKADVRCVLSKGWSDRLETKDASKPEIPLPPEIFQIQAAPHDWLFKQMDAAVHHGGSGTTGASLRAGIPTVIKPFFGDQFFFAQRVEDLGVGMWMKKVNTSVFSRALWEVTSSERMIVKAKVLGQKIRKDNGTQVAIQTIYRELDRARTLIKKHTKQDDDQTDEFEEDWTMIEEGEEMDAAAHGFEVQQPLAGINQDASRTGRGSLVLGSMVLRGAGAQKRASESAHEE

SEQ ID NO: 7652 - protein, 1319 aa, Hydnomerulius pinastri
MRIGTQTLIQALQALPWVDDPDNEDEKMSPNVPQMDSDSDDEQLDEPHMASSIHAIYRPVARSRRTETSQSLLTGRGLTVQEEVQEGADTDPDMNLASEDDVDVDDFEATTPRPPGTQTTDQLATPVPPPATVQLGPAMRRREPSRTGSMTTVKLNRRTRLAEKLKEIFELDIISEVLAEMPCWLLRSVLLQGYMYLTNSHLCFFAHMPSREDQVLKSGTLSKKATRTKRWIKHWFVLKNDTLSYYQSSSDPYFLNGIVDLRYAISCDPAGEREIRLRTNQKTLYLATDSVPSRQEWVKAIRKVIFKAQNMGDTIAIPYSVILDVEKSSAIDFSETIEVKVFDKEEHCSIDSYFFAYFHDIQAALEHIRDAVRIHRILPPKSPQALLDTTTTRSPTSPVHGIDRARSLPTPDVKSSSSFRLSAFLRPFQDSLPSPLARMYSAPEPPEGSEDFTHISKRAGTSFVPVTTLPLSSSPTTGNITPTSAHGLSADSQSRDHTYPPSTSVGDLASASSPSKSLAASVPWNVGVPSWLKVPRKGLSSSASSNAVAPAFPASQSTGGIREVYSTHRSSSLGQASGTPGGELGYSVLETAEAAVDPEMAEKFRSWFAFDERESLLGYFSGYLFRLLPVSGRLYVSTNYFCFKSTGPLSTKTRMILPIRDILTVEKTKAARFGHHGLIVVIKGHEELFFEFGFEDRRRAFVSILERQMDDIRKRPNAGDVPALSSGKKDALILEEFEPRESFSSDNDPAPPSEAMSESLPAVMFTSASSTFLTFKPKESLHFTFLTIGSRGDVQPYIALAKGLMADGHRVKIATHGEFQAWIESHGIEYGYVGGDPAELMRICVENGTFTVSFLKEGLLKFRGWLDDLLKTSWEACQGTDVLVESPSAMGGYHIAEALQIPYFRAFTMTWTRTRAYPHAFAVPEHKMGGGYNYMSYVMFDQVFWRAISGQINRWRRNVLRLDNTSLDRMEPHKIPFLYNFSPAVVPPPLDWPEWIRVTGYWFLNDADVGAKKWTPPPDLLPFIDSAHQAGKKVVYIGFGSIVVSDPKVMTRIVIEAVVQSGVYAILSKGWSDRLNTQTAEASQTEEPLPKQIYAISSIPHDWLFQRIDAACHHGGAGTTGASLRAGIPTIIKPFFGDQFFWADRVEALGIGSGVRKLAVESLKEAFISATTDQKQIDRAKLVGEQIRSENGVATAVEAIYRDLDYARSLIRLSSNTIAGATDDNDGTREDQIPDSSISTLNRSRYDSLGSQRGSEDWSVISDAEDRRSSFGSRMNEGKLDRSITLKRNSLAAAVMSVLPDALTSSNHRRTTSASSAQP

SEQ ID NO: 7653 - protein, 1288 aa, Naumovozyma castellii
MPLPKNTKEITTCLPETSPILKSADHISKSLSNIKPKRGVTDIPRAMTGTLVRTILPEGKSKSRSKRNSEPKGEEADLAKSKYMMKSIAGLLTTASVYAGLDNIQNADSLAMNSSEIKEDDMANKQEEKEQKSTDEPLAISPDVKVRKPTLFDISIVPKDENDSEKENPEYLSAKRNMIIKKLSEVFTLPQEEKFMEEFPSWILKDVLVQGHLFVTTSHLLFFAYLPKPSGAVKMSGNLYIRSALTGSTRYWGVLKDNLFSLYNSPTDIYFPVLTIDLRNVTKIEVQKSFRSHNPTEYFKIITNEKTFKFIADSVNSATSWCKVLKKQQFSCQNTSNNSISLKIPLSNILELEDQKLVNEASIFVVKALESPETFAVDDYVFMFLDDSGSTLKNLLETRLKELKENNINILYGAEEEEKEEKLEPMNSDDLVKSIPKYIRTENILRQELAKLSLRRLTPQFYVPTAGSLIPQTPNVLSGGLNYLPSPTDYLPSRKNLPLTLASSQNPILDEIRAGPLIKRIRAKSGHWLKKRHQTDDNKIEESIVLENQSDSKLQSNEHKQPLNTDESTTQLNSISIEDQGSEILNDTDSIQSFELKSSPSKKGAVSTWAIHPLKNVTSMWQSTPLHYPNKAIEFTDDDKSLITSEKEVTLSNDRFRRHFILDENEFLISAYYTHLIKNVPMYGKFYIGDEVICYRSLIPGSSTKMILPLRDIETCYKEKGFRFGYFGLVIVIRGYEELFFEFASSLSRDDSEIIILKQVEKFREQQGTKDDDTNICRTESNTQHAKLKFLEDKISAGGYEVPLMLEQNPHFDVKITPNKSYNIGLLTIGSRGDVQPYIALGMGLIKEGHNVTIITHEEFRPFVESHGINFVELAGNPAKLMSLMVEHESMNIGLLREASANFKGWITDLLESSWVACKDLNLDLLIESPSAMVGIHLAEALDIPYFRAFTMPWSRTRAYPHAFIVPDQKKGGNYNYLTHVLFENIFWRGISGQVNKWRVETLGLKKTNLYLLQQNKVPFLYNVSPTIFPPSIDFSEWIKVTGYWFLDEKLNYKPPDDLIAFISKARTLNKKLVYIGFGSIVVSNAKEMTMALVEAVQNAGVYCILNKGWSDRLDKKEDKLEVELPECIFNSGNVPHDWLFPQVDAAVHHGGSGTTGATLRAGIPTVIKPFFGDQFFYASRVEDMGVGIALRKFNTKTFTQALKDVTTDKRMYNKVQEVKKQIAAEDGVKTAINCLYCELEYARSVTEDRRKRTKDPKNPLQSMKSTVSNVVPLDLRSMGLEDSWILL

SEQ ID NO: 7654 - protein, 1532 aa, Cavenderia fasciculata
MNSTTTTTTTTTSSTHNHDNNNNTTLLGDYTTHKIPYDLIFIFLIGSLSILTYFIYWLVTYLLNTHLCGNTTTMYKKIPQISIDSLSSLSKSVLHSSSQSINDTDDDLSDYVSINESVLHHHQQLQQQREGHSHSHSHGHSLSSSSSSSTTTTHFNIPKCVFFEHPSGSGVVADDDLENDQPIIIDNQPVTIEELKQRVIKELADNDLWKSPVDTRILALVDCSLLHNHLTNANLIITSTSLCFLPTEQVHKGHAVESYLHMKAKSDFFWKKYWFHLSGGSLSWYRSSEHKEIYYPNGSIQLKKITSIQKLPSESATRPFCLQIATNAQIYLIQADSETQLDQWFSEIVHIQRNLTISLSLSDIVTMQMESDAALFFDSIYITLKRGDNFIITPSSRPNEIYNLLLSAWGKSKKLESIDQNTNINNNQTSNNNNNNNNRQTIEFQKVFKLNQFVNIILEKPCILFNDIETSYEGVVYAAEDGLYFNSDHNQNGSVALIIPVNDIISIQIDPESDIPEAIKVVTKEYEAYYFDLFDDHESFYESIVSIFTQFNPAIKYGKQGEDFFIKQQQVMKSEEEEEKEKENDSRWFHLPVIPISIPKSIPTRLFRSKSSPASVSPPLNTTPPNGSPLNSQSPSIHSTNSSPALSQQLSSLNLHDTSRTIFIQKGSPQNIQSELHQLFPTLPLNEAVQMYQSCTLHYDHMTNVSIEGHIYVTKSYVAFAPINSQSSSSLTSSTSFKSITPSSSPLSSSSFHLYNHNQNNNNNNNNSNSNKDNSSHNKKRLMKALIPFEDVVSIKKDRTIFLKHCIKIITNDHKWIFGSLNNFYSLYKILLVNWTPINEGLFTPLQSNQIREKFGLPSDEPLITWYNCTNFRGAQLKYGVLYITKHYLCFRSKLGFKKRTIVVPFSSIVSIKKYSGTILPNGIKITTTQQDIDFASFLHRGRVYRQLIECWNDNRGTLQKSTNNTSISNNSSGNNNGQKIGGGGIPKLNIDRIQVTSASTSPLVISPTVQSPRTNLNITILTIGSRGDIQPFIALALTLKNAGHNVVFASHELYRSIIIDTYGLTFKPLSGDPKELMDLCVRNGIFTPKFIKEALSRFRQFIDDLLNSCWEAAQGADALIATPGCFAGPHIAEALQIPFFHAFTMPFTRTRMYPNPFAPFAASQLGGVFNLATHMMMEKILWQPISGQINSWRVERLKLPAWNSSVSINETYRLPYLYCFSKYLVPKPSDWGSEICITGYWFMNETNMPEDKDHPPSQELIDFIERGDAPVYIGFGSIVIEDPNELSRLLQEAVKLSGRRAIISQGWGGLNIDQQVGSTAADAEFVQKNIFLLKQPVAHTWLFEKMSLVIHHGGAGTTAAGIYAGKPCIIVPFFGDQFFWGERVQDMGIGQSLSSKTLSAKSLASSINELIDSKSAHIRVKEMANHIRNEKGLKQSLQDFYRYLNVAYVPPSKTPMGSKTSCRQCKQGFGLLNQMVNPLVQTKFHCHCCGQVFCDKCTLNKIPLPKFRINIPVRVCDTCYSNQFTSNSNNI

SEQ ID NO: 7655 - protein, 1325 aa, Wickerhamomyces ciferrii
MEEDTLPEERSRRSRSPTLERVNRSFKSASRSLAALSPPPVKRSLSPLASSLSRIGTRRSSSKSITDSNAYHVSKGGGGAGDQLDVAKPSGMAKSFVSMLTTASMYNGNLQDIIDEEEPVADSQIQINDTATEGNASDLDVDTEADTGKNHDQEEQQPIESKQNEIPTLEDFPSLERSPTLFEISIAQKLNQHSKDVNDCQKRAIALSNKLKSVFQINSNDIFLADFPCWLLKDVLLQGHIYLTQSHLLFFAFLQKRKPDKIALKGNLSMNISLTSPRQNRYWAVLKDQTFSLYNNSTDLYFPVLTIDLKNALRAEIITETGGLLPHVPGVPGKHHQDHTSKSNGSWFKILTETKSYKFQADSSHIARSWVGLLKKHIFASRNKGDSVSVKVPLQNILDLEETPIFESAETLKIKVLENSESFVVDDYFFMFFNSGPEFTKLIHEAIEANTNLSSDNNNFKIPENVVDSTGKLDLNTIKKSKTSNFFPLKKVLSKTRSRSNSNTSNKPISRCATHNNDEVSPPLSPISAPPTSSYSLQGNFSPTSFNLQEPVVEKFNGSDEVSSANLTNQEDVLVTTSDEEAEGGDVEPEDFISKQLEHDNLLQPKDTNKSSSLLPAYINPGKALNQAKSSITKFTPKVIKSASFMWQSNPVHYEEENSLERGLEDEFLATPKERIEANKRFLDHFTLPENNFLIAAYYAHLQRNVPIYGKVYLGVKEICFRSLVPGFHTKMILPYKDIENIYKEKGFKFGYSGLVIVIHGHEELFFEFSSNIARDDCEFLLLKQLDKFNSTIIDNGSNDVESALSTSGKLQAAKIQYFEDKIHSDTGFEVPIMIEDHPLMKTSIKPSTPRKFTLLTIGSRGDVQPYIALGLGLKKEGHIVRIVTHKEFEDWILKHGLEFKEIAGNPTELMSLMVSHGSMNVGLIKEASSKFRGWITELLNSSWEACQDTDILIESPSAMGGIHIAEALNIPYLRAFTMPWTRTRAYPHAFIVPEQKKGGSYNYLTHVLFENVFWKGISGQVNKWRKEVLNLPKTNLDVLQQNKVPFLYNISPTVFPPPVDFNDWVKVTGYWFLDEAIDYKPPKDLIDFINQARIDGKKLVYIGFGSIVVSNPKELTEAVVEAVLESDVRCILNKGWSERLGGSNVVEIELPYEVFNSGSLPHDWLFPQIDAAVHHGGSGTTGATLRAGLPTIIKPFFADQFFYANRVEDIGAGIGLKKLNVKTLSKALKEATTNIRMINKAKIIGEKIRKENGVTNAIETIYRELEYAKELVNNKKSVIITNEEEELIDEDSKSQIMNINEIDDVAKQVDEDKDLEEEGSWLLV

SEQ ID NO: 7656 - protein, 428 aa, Unknown
  Description of Unknown: Candidatus Filomicrobium marinum sequence
MNILIFTFGSRGDVQPYVALGTALRRGGHQVCLSTGQGFDDMIAAHGLTAAPLSINYRELIDTPEAQAAFRSMSGKFRAMRAFKDVVCEQFREMWELSREVRPDVIIYHPKGFIAQDIAAALGAVAIPTTLQPSYVATSEFPNPFLPFTNLGAFGNKLSHHFIERLTFWAQRNMEGRWRKEMPARANSTSRGTFFGGHDPEGRTVPRLHGYSSIIVNRPRDWTAREHITGYWFFEPNTDWEPAEDLHRFLATGPPPVYVGFGSMPAADAQSQTGMVIEALRQAGQRGILATGWGGLKPLAGSANDVLFLDVAPHDWLFQRCAAVVHHGGAGTTHEGLRWGRPTVICPLGVDQPYWGRRVNALGAGPPPLPQKSLNVADLSRAIGESLKPGTVARAAKLGEAIRAEGGADAAAAVVNGFVVGAGRPHAS

SEQ ID NO: 7657 - protein, 1312 aa, Plicaturopsis crispa
MRAGTQTLIQALQAIPWTDDPDQDDEILNHGLPVDSESDDEAKPTRIASSIHTIHRPVARSRRADLPPSPASKSKSHAFTVDERDDDSLTSDEDIEGEDLEASTPRPPDGPSPGHLSRLYTSSAPLSHSVNVLPPSRSIMSRTGSMATVRLQRRSRLAEKLKEVFELEGIEEVWAEMPCWILRSVLLQGYMYLTNSYICFFAHMPSREDQILKSGTLNKKATRTKRWIKHWFILKNDALSWYQSSSDPYFPHGIVDLRYAISCEPQGEKDIHLRTNAKTIYLSADSVPSREEWVKAIRKVIFKAQNMGDSIAIPYSAILDVEKSTAMDFSETIEVKVREDHFSVDSYFFAYFHDLQGALEQIRDAVRAHRTLPPQTSPRQVLDTTLSRSPSDPHQHPAERAQTMPESQSIFNRGPFSLTGLLSPLRSASDTPVSGRGASSPANPEQAEGFTHITKRPTNSLISDVTPEEVLPNEPHRSTTTSTTTLTPSSSRLEHTYPPSTPTVDLYPTVSREASGSAWTVGVPSWLRGSTRKILPSSMSNPAVVEPASPTGVSEVYSSTLSSSSSQSQSGDLGYSVLESPEGAVDGEMSDKYHTAFAFDDKETLLGYFTGYIFRLLPVYGRLYVSTNYFCFKSSGPLTAKTWMVLPIKDILATERTKATRFGHLGLIVIVKGHEELFFEFGDEGRRNAFVKLLESQMEDVRQRLALGEPVSATAGERDALILEEFEAKPLNSSDEPRPAPDNMADSLPAVMFTSASSTFLTFKPKESLNFTFLTIGSRGDVQPYIALAKGLIADGHKAKIATHGEFKDWIEAHGIEFGYVGGDPAELMRICVENGMFTVAFLKEGLQKFRGWVDDLLKTSWEACQGSDVLVESPSAMGGYHIAEALGIPYFRAFTMTWTRTRAYPHAFAVPDRKMGGSYNYMSYVMFDQVFWRATSGQINRWRRNQLGLAGTSLDKMEPHKIPFLYNFSPVVVPPPLDWPEWIRVTGYWFLDDAEVSAKKWNAPSDLDAFIDNAHSLGKKVVYIGFGSIVVSDPRAMTRCVIEAVVKSGVYAILSKGWSDRLNIKSEEVAEPEEPLPKEIYAITSVPHDWLFQRIDAACHHGGAGTTGASLRAGIPTIIKPFFGDQFFWADRVEALGVGSGVRKLTVDSLMDALIAATTDSKQIYRAKLIGEQIRSENGVATAIEAIYRDLEYARSLIKRAARDDLTEEAVLMADNSTIRDEMTTSPVSGRPLSGYSSSGRTSEDWSVVSDGDDRRDDRRSSFSSRRSEGKADKSFKRKSLAAAVLSVLPDSLAPTNLSHRRSRSSSSAKS

SEQ ID NO: 7658 - protein, 1534 aa, Sporisorium reilianum
MSTSQPHSPRELSSSLANDKAAAADLDPFSLDDDAHEEQLPLPPPAQIPDNLDTPPFPTSPRLDPWSPRNYSTISSLAGSRELGRPALEPTTKIFTQSAATPPLSSAPSTGSVQPTATASSNDLSTAAVQPDAFDVSFHAEPQGLMQMLSLVGSTFFDADTDGYTEDDADELEAPADPTHRHREQQRRVTHAEPTQQEPQSRHSDHDQRTLKGRVHALARDDGSDDGSTPQGSRSPLDASVLTIGPSRPKQTSLTQSDIISSSRDSAATRAARRPSNLRSQLHNVATASMFASTSTSNLGNSRLDQDARELRPGSSPFDVDPSDTQHVPAAEQQRGMPRLPSSNRGLDPLLIRPYLETQPSGQLPPADNAGMDRDRLLQQLKDVFQLDAAETLLLAQPCWLFRSLLLQGHLYLTSGHVCFYAYLPSRDEKTIKTDWLRKRTRRTHRFSKHWASLKAGKLSWFDSDRDPYFPQGHIDLRKVSAVERSSTHKDRFKVTTPARRFIFLTEDEPSRDAWVAALQKETFRAQNQGESVRISIPLETVMNVDTTLSVDGTEMVCITVVDEAGDFSVDEYYFLHLTKPSAFMADLSSLLEQAGRGSVASLHSGEAALNLSRLSIRDSTGATHAAAISRKSLEEVPTLPKVRVAMQRNDEAEHAVEASESDVPQRRGSTDKQHEHELPSTSTSTATSAIAVPISIRKNSHEASAADAILSTTPRAAALNRLSMESTHTYPPSPSTSDPPSSFDQVQKEAERGWAIPDWLRSAPARVLGRGSDASPAAASHPKAPTTGASSTRRRRKVLEQWSDDKADDVSRGDSSNTDNEDDILSHSIHSAQSNYSMLDADDQEAEPADHASVAAEFRDTFGIGEDESLIGHTHAYLYRVLPVAGRLFVAEHHLAFRSSGIAAKTVGRTLMLVPLQDVISAAKHVAFRPGHHGMVINISGHEELFIEISSAHRRDELLSLVEYQLELIRGGRGSRQSREAVTRERSHALVLRDLSERINDAPATASMTSSADSSVLSQTGSRLGSRSNSLSQVGGGSSILSFSPPTPLTFTMLTIGSRGDVQPYIALAKGLQADGHRVRIATHAEFGDWILGHGIEFSEIGGDPAELMRICVENGTFTVSFLREGVTRFRDWLDDLLASAWRACQGSDVIVECPSAIAGIHVAEALQVPYFRAFTMPWTRTRAYPHAFAVPSKKAGGNYNYMSYVIFDQMFWRASSFQINRWRKNLLKLKPTNFDKLEQHKVPFIYNFSPSLVPRPLDWFEWIHVTGFWFLDNPDNSSSKAWEPPADLVAFIRRARERGRKLVYIGWGSIVVPDAAAMTRCVLEAVRKSGVCAILSKGWSDRLSAGDARSAAPEVEDVFQVSSVPHDWLFPQIDAACHHGGAGTLGASLRAGLPTVVKPYFGDQFFWGQQIESLGVGSCVRHLTADTLAAALITATTNAKQIERARKLGEHIRTEDGIANAIKAIYRDLDYARSRIKRDTRIEGGAESTDTAMLRQPSGEDDEAGNTSDEWSDIGGAASPSPQRGSASAVLG

SEQ ID NO: 7659 - protein, 1289 aa, Amanita muscaria
MRLGTQTLIQALQAMSRTEPDNFTELSDQTNSAGSESEEETDGFNRLASSIHAIHRPVAWSRCRSNRSNARDRDTSVVEEAGPEELLDSGEDEGEDFEDSMPQLRSPASGGESGTAGASQQTTILSYSRPSAPRTGSLNTIKLQRRTRLAEKLREVFELPGIEEVCAELPCWLLRSVLLQGYMYLTNAFLCFFAHMPSREDQVLKSGSLNKRAQRTKRWIKHWFVLRNDALSWYQSSSDPYFPQGIVDLRYALLCEPVGEKDIRIRTNQKTVLLSADSVPSRDEWVKAIRKVIFKAQNSGDSIAIPYSLILDVERSSAMDFSETIEVKVFDKEEQYSVDSYFFAYFLDMSAALEQIRDAVRAYRTLPTTGHPQSVIDTTSSRSGTNFAIERSATLPTEPSSPKSTSVFRFTSLLRPFSSTTSSPTSGVSSPESADDFTHVSKRANSSSFIPVTYSTTPAVSSSGPSRGQQASTDPAKASTGHTYPPSTSFSSVHPDKSSLSRESNSSWSVGVPSWLKPPRRIFGGPTTSSYPPLPSFDIAGVREIYSSMSPTSARPPGSDMTYSVLETPEAVVDLDTTEKFRTAFAYDEKETLLGHFPGYIFRLLPVYGRLYISTNHFCFKSTSPLAGRTRMALPIREILAVEKSKPNRFSHYGLIIIIKGHEELFFEFGAEDRRDAFVALLERQMEDVRKKQASQDTGADTVKHDGLILEEFEQRVAHDDNDPPLTVPDEMTDSLPAVMFTSASSTFLTFKPSHSLHFTFLTIGSRGDVQPYIALAKGLIADGHRCRIATHGEFRAWIESHGIEFGYVGGDPAELMRICVENGTFSVSFFKEGILKFRGWLDDLLKTSWEACQGTDILIESPSAMAGYHIAEALRIPYFRAFTMTWTRTRAYPQAFAVPESKMGGSYNYMTYVMFDQVLWRAIAGQINRWRRSTLHLASTSLDKMEPHRIPFLYNFSPHVIPPPLDWPEWIRVTGYWFLDDADVSAKKWTPPSDLDEFIDKTRASGKKIVYIGFGSIVVSDPKALTQCVVEAVIQSGVHAILSKGWSDRLHSKSSEASEPEVALPPQIYPISSIPHDWLFKRIDAACHHGGAGTTGSSLRAGIPTIIKPFFGDQFLWANRIEALGVGSGVRKMTVAALTEALITATTDIKQINRAKHLGEKIRAENGVATAIESIYRDLEYARSLIKAPPTETYLQDEAETQDSSAALSSDPQASSPLSGPRRSPSEEWSVISEQDDHRSSISSRHSGVVRENNSRRGSLAAAVLAVLPDSLTPSSPRRRAASMSLQT

SEQ ID NO: 7660 - protein, 412 aa, Janibacter sp.
MKVNIMAAGSRGDVQPMVALGVGLTRAGHDVTICAGNDFEGFVTGHGLAFVPAGVRIDELIASPLGVEWLGHSSRNPFRELSALRRFVRQSTQGYAGALVPLVGSADLWVSGVLTVHAVDALVSVGGGRHVVAEFAPMRPTRSGAATMQPAFTTRSSIANLIAGQGTLQTMSSVFAPPGDRLRAELGLPATGRRGFLDAIRRTPGVLAASPLVVPPPSDWHGTSEATGYWFLDEKATYTTEPALAAYLKEGSKPAYVGFGSMSTREAAATSEVVAEAARKAGVRVVLHAGAAGLGSTDDEWVQVVGDVPHAWLFERMAGVVHHGGAGTTAAALRAGVPQAVVAHIGDQPYWARRVWELGVGARPVRRHQLSAEWLTEVLRGFARGESAARAAAVGAEIRREDGVGRAVALLT

SEQ ID NO: 7661 - protein, 1533 aa, Candida tropicalis
MPFYKKVTHALIPESIHNLATHHGCGDDKSDKEVEKTTSVPTASSKDDELTSARERSTYHSISGRLSYEDDDSDDDFDAAKVEEGGTFFSELLNTATICSGLGSLNTLKKQYLDELLKKSGLHNLKPQQQHHHHHSPQLAGKHDRNQPVASSVNKESSLGKSQQFSSEDSDESEDSSIEEEFVANDLEATQISGTNEPFKSTSTDTSPISKVETVASTTTASSATATPTATTQVKVATETKVAHIPHEDLEGLNPLQRSVVTNLDPHSIKEGILIKVKPGQRPTEEELQNEHEQIKEKIRLRLKIADKLQKVFSLDDTDEFLGNYSAWLIKDVLLQGHLYLTKEALLYFAFLPKRFSVEHASEVLNIDDSSNIVHKGTLGYKPRKYGEVILNAVVQHRYWAVLRSETLSIYSSATDLYFPELVIDIKTCLYAEVVDKEKYGKEAISPVNRSGAQSPMGPNSGTETPGTPAIEEYTSELNSMMSADSFAPTEDTVESGSTNIWFKLVTQKRTYKFQCDSSFSARQWCNNLTKLIFQHHNANTSSEVLIKIPISDIVEYNKRTLFDEEADHDIDHAKNDIPLNLSIKYLANAPVSADLAKQKAKSKKTLKEQDNMTIEEVNFLFPKNGVEFFETFDNAMHDGKQGVDELSKLTTVDSSTSLKSMSTLSPSSNALVKTVMDHNKYTEPNDGASTLKKLSKTITSPTRIFRAATLGSLDRPSIASVTSNDSTGKDSHLQLPRALSERGLQSLDISFVTSLKKMEEAASRYDKPSFSPDELPLPSNLTDPFEVKKQSRRPISKSIKALSNVASRWSSTPSHYVDDGRFYVGDASEREESQRNFQGHFSTNSKLLATYYAHLLRTVPVYGKLYISETEVCFRSLLPGVSTKMVLPMMDIEDVKLSAIVKLAYYRLSLMVNGAEELSFEFGSSKSRDDFREIVLTQLEKLHSNEGFRPKPHQWGSNYDIELSKTRMEYTDSERCQIQKAFDDTSKDVQLAEQRIELARVRMFEDRLMAASGLDVPIILEDSPFFKTEMRPSTSYNITLLTIGSRGDVQPYMALGKGLVKEGHNVTIATHGEFGDWIKKSGFNFKEIAGNPAELMSFMVTHNAMSVSFLKEAQKRFKSWIAHLLTTSWEACQGSDILIESPSAMAGIHIAEALGIPYFRAFTMPWTRTRAYPHAFFVPDQKKGGTYNYLTHVLFENVFWKGISGQVNKWRVEELDLPKTNLYRLQQTRVPFLYNVSPTVLPPAVDFPDWVKVTGYWFLDEGSGDYKPPEDLVKFMSDAAADGKKIVYIGFGSIVVKDAKSLTKAVVGAVQRAGVRCILNKGWSDRLDDKGKDKIEVKLPPEVYNSGAIPHDWLFPRIDAAVHHGGSGTTGASLRAGIPTIIKPFFGDQFFYATRVEDLGAGIGLKKLTVKSLGNALVTATEDLKIIEKAKRVSEQIKHEHGVLSAIEAIYSELEYTRNLTLVKNIYDQNYKRHHPDFKSQSGIQSPVEASEDEDSEDEDDYDDEDSEECNEEKDVYGDKLSEQDSKKQAQL

SEQ ID NO: 7662 - protein, 1464 aa, Ceratocystis platani
MSSSLVAIPPSDDPPPSASASASTHPSSRKPAALSRQRPESMGPSTIPELPDRLKEADDSDEEDVVAANRGMVNMNQSLFGLLAAAGSNVDFNQRFQDHSSDDDDNDVNSPEPSRPLPKPKRAVAVGRDYDDADNRHHRSKLASHRRRISESRLLKSFANLPHFRKSRTSKSSSLQAGDGESRSHSRSHSRSHSHSHARSPSSSAAPPLFGHRDSDSSLAEVDVDANDAALAPVMSRIIDGQAEMAARPSFDLDGIMRDQLAASTTTLKPSTGVIREGATSASTSTLAQKLKAIFEFDEPEDVIRERVASRLHDKVVKAGFLGKAGRRSPKYNRYHFRLKGDQLTYHEASTDLYFQTGQIDLRYGMSAMIVDKDKEGTHFNLVTHERTYHFRADSPASARDWVRGLQRVIFRSHNDGDSVKISLPIENVIDVEDTQMLDFAETIKIRVIDNDDTFAIDEYFFSFFSNSQEAMALLKLFCEKAQGSKNKERLLQKPHSASASASASASACHSASVSLPVSGSHTPDPDGSQARTHAQANNLCVRTAKLPETVKATLSPMSPHATHTHSPSPRASIDGHRPSFDTFRPFGRRSMDRQSIATLDAPTRRSFSQSRRSISGQRVSDKSLSSGLSGSGFTDMKNSMTESYAQSGSVDDYSMAMISSIEDHSVTGSQILHGSDVFRTSQTTKTPPLDVPEQKDGPAVGTIGRKEPRSAKNGDEEDLESQGQTLQGIAKMGALPLQRAGAWAGYLNRTSRKMSSLLATESMGYVEKVSGMWKGGRKHYHSTVNTKRDKDDPADGTQELDEDKIGSSNERFRSHFGLPESESLKATYFCYIMRVLPLYGKIYLSDRMFCFRSLLPGTRTKLILPLKDIETADKEKGFRFGYSGLVLVIRGHEELFFEFGQAEVRDDCHNMVEGFLEASRLLRSSGFASEGEDEKELARNALAEHDALQAERLLKEKLAETAKLGDSTPVLFDDTKPSMINLKPTAPLRITCLTIGSRGDVQPYIALCKGLLAEGHKPKIVTHAEFGDWVQSHGIAFAPITGDPAELMRLCIDNGMFTWTFLREATTMFRGWLDDLFLTAWKGCQDSDVLIESPSAMAGIHIAEALGIPYFRAFTMPWTRTRAYPHAFAVPEHKMGGAYNYMTYVMFDNLFWKAIAHQVNRWRNTVLKLPSTTLEKLQPNKVPFLYNFSPSVVAPPLDYSDWIRVSGYWFLNEGSGEDWKPPADLQAFIDKARADKKKLVYVGFGSILVNDPGKMTQEVIDAVLNSDVRCILSKGWSERQTSSQTSSGKSAAPKAPEPTIPDEIFVIKSAPHDWLFAQIDAAAHHGGSGTTGASLRAGIPTIIRPFFGDQFFFGTRVQDIGVGICLKKWGANSFGRALWTATHNERMIRKARKLGESIRAENGVATAIQSLYRDLEYARSLIQRKTGGKDGGGETEEAEAEEWTFIGGDEPDPEVVTQRLSEM

SEQ ID NO: 7663 - protein, 517 aa, Schizophyllum commune
MIVGSRGDVQPYVALGKRLKQDGHRIRIASHENFRSFVNDNGLEFYGIGGDPHELMSYMVKNPGLVPGMESLTNGDIPKKRKVRSEESLQLAFMLQGCWDSCSSPDETTGVPFMADAIISNPPAFAHIHCAEALGIPLLLSFTMPWCATGAFPHPLVNVKFSNAGERLTNHMSYAVADILTWQGMGDIINKFRNRALGLPSLSVRSGPGLADRLKVPWTYCMSPALVPKPKDWSNHIDVVGFYFLDLAASFTPPDDLAAFLASGETPVYIGFGSVVVDDPGEMSRIIFEATAKAGVRAIVSAGWGGLGGLEVPPHIYIVGNVPHDWLFAEGRVSAVVHHGGAGTTAIGLSKGRPTVIVPFFGDQEFWGDMIHRAGAGPAPIPHRKLTVENLADALVYATSPPAQEAATKMAKQITTEDGVAAGAESFYRHLPLLNMRCDVCPDKVAVWWSTDQCLKLSALAAQTLIEARELKLEHLDLHRTKEYESRKKFRDPLTAGVGAFFWTILQCEAGLVELFT

SEQ ID NO: 7664 - protein, 1463 aa, Pluteus cervinus
MSNTFQEPPSLSDINLTPTAPDAALAPETMTQDRPTESSTSPTSSRVKRLSNVVEKTVEKTVDKLNRSLSGRSSSSGHSTPPASSRGIFSINHKGKGRQESGDIDASTLVSSPIMSSPISPRASSTPSTIVPHEDSPFIRPPSPLPTRPPSTPFRGAGSMRPGTQTLIQALQALPWLDAENEDDLSPLEHGQDEEGSDEERDKAHDRLTSSIHTIHRPVARSRRVGVPSNALRPFRERATEDEQDGDRSDEEPEDEDFEDGTLKVPVTTTLHPVGQKAGPSAPRGVDPRVSRILPSRTGSTATVRLQRRTRLAEKLKDVFQLDGIEEVVAEMPCWILRSILLQGYMYLTNSYLCFFAHMPSREDQILKSGSLTKKAQRTKRWIKHWFVLKNDALSWYQSSSDPYFPHGIVDLKYALSCEPVNDKEIRIRTNTKSVMLSADSIPSRDEWVKAVRKVIFKAQNMGDSVKIAIPYSAIIAVEKSAAIDFSETIEVKVVDNPERNADDSYFFAYFHNLPAALSQIEEAVRAYRNLSIQPSAKLVLDTTVPRPTSSSERAVVSAGPATTPRSTTSVFRLASLLRPLQAGISTVRGTASEPPPELSSDHDDFTHVSKRANSSFLPYTTSQRIDSQGSSDKAQDDVKGVTSAASPNHTYPPSTSNAFIYSDYTFSSRETSSWASVPSWLKGTKNLISTSLGYNTLSATPTGIREMYSSTVASSSPTPSRPNTNGLGDLAFSILETPTIPLGLEMVEKFKKAFAYDDKELLLGYFPGYIYRFLPVHGRFYVSMNFCCFKASGPLSVRTNMTLPIKDILATEKSKAWHFGRYGLIIIIRGHEELFLEFNDEEKREAFLVLLNRQMEDVRRRALHGEPIPASPGKRDALILEELGPETSTALLNPAAHLSESVSDSVPAIMFTSGSSSFLTFKPSKPMHFTFLTIGSRGDVQPYIALAKGLIADGHRCRIATHGEFKEWIESYGIEFGYVGGDPAELMRICVENGTFTLSFMKEGLQKFRGWVDDLLKTSWDACQGTDVLIESPSAMGGYHIAEALGIPYYRAFTMTWTRTRAYPHAFAVPEHKMGGSYNYMTYVMFDQVFWRATSGQINRWRRNVLHLGGTSLDRMEPHKVPFLYNFSPHVVPPPLDWPEWIQVTGYWFLDDADVSAKKWAPPPDLVDFLDNARNLNKKVVYIGFGSIVVSDPKTMTRCVIDAVLESGVHAILSKGWSDRLHVKTNDAAEPEERLPPQIYPISSIPHDWLFRRIDAACHHGGAGTTGASLRAGIPTIIRPFFGDQFFWADRVEALGVGTGVRKLTVASLADALRTATTDIKQIDRAKLIGEQIRQENGVEKAIESIYRDLEYARSLIKRRGVDEDIDDLDDLEADGSTILASHGQDYSGYDSSGSGRGASEDWSLVGDSEDRRSSFGSRISEGRPSKDSPNKRSSIAAAVRSVLPEALTSTSPRSSLSLSRS

SEQ ID NO: 7665 - protein, 1241 aa, Ogataea angusta
MSGIESTEEPCDSMTESQSLSPLEPEERQTRKDSGLQSQSLTKRHFAFSPHRLITSISRHTSPHKPRPKSESRVPVPKLHSLPPQRLASPERDKPSIEGISKSFVSFLTAASVYAGFQDLEGEDQQVSPDDVSAGESEDQQADESSDEQEDDDQDDRTFYATDPSPTELTINENTPLPEPEPPRRTLRKARSRFEFSVVKRLSENENDQLAQKRAIALSNKLKRTFDISDTDVFISDYPCWLMGDVLLQGHLYITKHHILFFAFLPKKQGSISKSGALTTKSYPSLREHRKWAVLRNNTFSVYSNSTDLYFPLLVIDLRTALRAEILQSSSTKQNPSKPVWIRIITESRTHWFLADNLASARSWVSSLKKHIFASRNKGDQVAIKIPLQNVVDLELTSVIGVTKNLRIKVIESADTFAIDDYFLMFFSRGEKAVEDIKKVIHDAGMEISEGTSTESEDEQGVDNNLLKSKIELLKKSPSMVQTSSKSNVPVIRMDEPADDFSQEQESAESSKPVSDDEIVSADDNQELEEKQPQDNLANAEKENHDKVSRANSRRTWSTRSLVQGLTAITQGWMSPSPMAHFDEKYAVLRGEEDSYFVKDAEQRKAATERFRKHFSLTDGEKLIATYHAYLVKGIPAYGKIYLGSNEMCFRSTLPGTGTIMILPFSDIENVNKEKGFRFGYSGLVVVIHGHEELFFEFASDQARDDCEFMLLKQMDMFKKGSTDSSPPNASEGSSDESCNLAESNTSLASARLRMFENRIHDAIGLDVPIIIEEHPLTKTKVRPLKSYRFTLLTIGSRGDVQPYIALGKALMKEGHQVRIVTHAEFEPWIKKHGIRFASIAGDPSELMALMVTHPTINYNFIKEAKSKFRSWIDDLLVTSWKACQDTDILIESPSSICGIHIAEKLQIPYFRAFTMPWTRTRAYPHAFMVPDQKLGGAYNYMTHVAFENGYWRGTAHQVNKWRVETLGLPKTSLAEMKQNNVPFLYNVSPTVFPPSVDFAEWVKVTGYWFLDESETYQPPEVLTKFIEQARKDGKKVVYIGFGSIVVSKPSELTQAVVDAVLEADVRCILNKGWSDRLGTKTEIEVVLPPEIYNAGSVPHDWLFPQIDAAVHHGGSGTTGASLRFGVPTIIKPFFGDQKFYAGRVEDLGCGVSLKDLNYKSLARALKEVTTNTRIIEKAKLVGARIRSETGVQTAIETIYNEMEYARSLSISKVKQVSVVKSDEEFDDDKDEEVEGSWLLV

SEQ ID NO: 7666 - protein, 1441 aa, Phialocephala scopiformis
MAPEEGDLKKRVARKLTKKRRDGHQATMEIPERFREGDDEDEDCTALHGANAYLNQSVFGMIAAAGSRTDFNARFDGQSSDEEDDSGEASNQSSELQVDKTRKGKSSPKPEKHHRRKFSENRLLRSISGIGSKSKSKASPTRTGPPTPESTFATPTPEIQVDRTTSRDAPVMSRMLEARAELSMRPSFDLSRTTEPAEMDENGHQTSSSLAKQLMEIFQFDTPEDVIEEYPCWLLKSVLLQGYMYITTKHICFYAYLPKKSNEVVKSGYLAKSGRRNPKYNRYWFRLKGDVLSYYSDPSDLYFPSGNIDLRYGISANVVDKEKGKDATHFTVVTHQRKFNFKADSMPSAKEWVKALQKIIFRSHNDGDSVKISLPIENIMDIEESQIVDFADTCKIRVIDNDETYAIDEYFFSFFSFGKEALNVLRILVEDTTAQQIPEAMLSPTAAQVEGKDSPKGRISLPKRNSSNSVHSPRESRPMPPPPIRTTTPVLEESVRATLSPIGAPSPRASTEISRASSDAYRRSMDLKAFGRRSVDLNRLNMDGAGGRRSLSASRSLSRNRVDGERRPSEKQGSSDSYVHSLEEPGSSGALPSASDGTQASASQILRGSDVFLSPTIQRAASATRSRDPESSPNDDSRSDSPSRNTVNLGGHPPIRHPATTGSLDGSNAGQGEASASAPTLQTLVKAGAYPLQRAAGFAGYLNRHSKRMSNLLATESMGYVEKVSGMWKGGKKHYDEPAALGSDDDMYGDIEDEQSGSGDRFREHFALPASEKLQAAYFGFLHRVLPLYGKIYISDRSFCFRSLLPGTRTKLILPLKDIENVDKEKGFRFGYSGLVVVIRGHEELFFEFPQSETRDDCAVTLLQNLETMRYLKESGLLTMEEKESAENASAEHKALQQARYEGHAEHDVKMPKSAEEARADGPPILFDDPRASILNFKPTESLKITCLTIGSRGDVQPYIALCKGLIAEGHRPRIATHREFQGWVESHGIEFKPVEGDPAELMRICVENGMFTYSFLREASSKFRGWINELLTSGWEACQGSDLLIESPSAMGGIHIAEALQIPYFRAFSMPWTRTRAYPHAFAVPDHKMGGAYNYITYVMFDNVFWKGIAGQVNRWRRKELGLQATSLEKMQPNKVPFLYNFSPAVVVPPLDYSDWIRVTGYWFLDEGGDWSPPQELTDFIKKARNDGKKIVYVGFGSIVVNDSAAMTETIVKSVLKADVRCILSKGWSDRLDKKDAAAVEVPLPPEIHQIKSAPHDWLFKQIDAAAHHGGAGTTGASLRAGIPTIIKPFFGDQYFSGSRVEDLGVGIFLRKLNISSFARALWESCNSQRMIIKAKVLGETIRKEHGVDTAIQCIYRDLEYAKSLIKRRDGKTADDTLEDSEESWTFIGDEHDPELVKRIHDWETMAQSGNLATSSIQPRRSQDTGRALGLNVRARNNAA

SEQ ID NO: 7667 - protein, 1396 aa, Aspergillus terreus
MRPLLDEAKRRVDRRLSASRQSLSTSRIFPSALPERLKDDHDAQVDYTAPPGGGGTKEGHFQYMQQSIFGMIAAVGSQSDFHARFDDSSDSERDTDRPPQKRTEKESQATDAPPSSKNEKKALRSPQRPKSPSQERGRRHRKTLSGSRILRPLMPGSSQRQGGAQTEPSTGNQMSRVPSPERPRSTTPRAAPVLSRMVEAQALFDSKGSMNQSPRSPPAETQEEQSQEQTSASPLSLRLMEMFGFESPEKVLVEYACSLVQSMLLQGYMYVTEGHICFYAYLPRKSTVAIKSGYLYKRGRKNPKYNRYWFSLKGDVLSYYADPSNLYFPSGHIDLRYGISASLSEPKEKDREARDFQVTTDQRTYYFRADSSTSAKEWVKSLQKVIFRTHNDGDSVKISFPIESIIDIEESPMVDFAETFKIRAIESGETYAIDEYYFSFFNDGQDAFNFVKGLVSESQAKNPSRESPQPGRTTPQSRARGSRARWSLTSGLSQVLGSSDARRRRSASASQFSPGRDAAGLSPTSRQRDLSESFVNSFDQATESSTVLQSMTDTAESASQILNRSDVFQYPAMQPFRRQSLSEDQFGRRHSDETARSTNDIARLGPGITPRDVQRFYPPSDSDHDAQDAARVQQSASSLNELVRAGAYPLQRAAGLAEYLRNRSKQMGTLLASESMGYIEKVSGMWAGGRRHYGEAEGILPDDQDVDPEDKEDGCNHGDRFRAHFALPPTEKLQATYFAYLHRVLPLYGKIYVSQKKLCFRSLLPGTRTKMILPLKDVENVEKEKGFRFGYHGLVVIIRGHEELFFEFNAADVRDDCAVTIHQHLESVRFLSESGMLAEQEQDESEAAKAEHRMLQEARKDASGGLIPQTPSDESPEIHPIFDDPRASIINFKPTESLRITCLTIGSRGDVQPYIALCKGLLAEGHRPKIATHAEFEPWIRKHGIDFAPVEGDPAELMRICVENGMFTYSFLKEASMKFRGWIDDLLSSAWRSCQDSDLLIESPSAMAGIHIAEALRIPYFRAFTMPWTRTRAYPHAFAVPEHKMGGAYNYITYVMFDNVFWKAIAGQVNRWRQSELGLKATNLDKMQPNKVPFLYNYSPSVVVPPLDYPDWIRITGYWFLSEASDWTPPADLMAFIQRARDDGKKLVYIGFGSIVVSDPSALTRTVVESVQKADVRCILSKGWSDRLGDPASVKSEIPLPPEIFQIQAAPHDWLFSQIDAAAHHGGAGTTGASLRAGVPTIVKPFFGDQFFFGTRVEDLGVGICLKRLNVSLFSRALWEATHSERMIVKARNLGQQIRSEDGVATAIQAIYRDLEYAKTLARQRSIVSSTPFSPTPSAKTVAEQEVDDDVTDSEEWTFIGDETDIDISRRVRGRAVSDVDMLPEPLAVRSPELAQ

SEQ ID NO: 7668 - protein, 1451 aa, Xylaria hypoxylon
MASHPEEDAVRRRVSRKILKQNREGRRPTMDFPDRFKDLGDDKDEDVVPRSQGPNMFMNMNQSIFGVIAAAGSTTNFIDRFEGQSSDEDGNDDDSDDNTKGERKGKGKQREQVAKTTILKKSLSSEEKNTSGGEKRQGTYGQLLQSLPQLPRLPTRPQSKRSKLKPFQPSDTSENANGGASTSPTAEFQTSVIEANVGDREVQPAPVMSRMLEARAEMSSRPSFDLEGGLSRDQQNEGDQTGPSALARKLKEIFEFDHLEEVMEEYPCWLLQSVLLQGYLYITSRHICFYAYLPRKAQEVAKSGYLAKSGKRNPKYNRYWFRLKGDVLAYYRNASNLYFPHGQIDLRYAISANVTDKDQDAVHFSVVTHHRTYHFRADSAPSAKEWVKSLQRVIFRSHNEGDSIKISLPIDNILDVEDSHMIEFADTCKVRVIDNDETYSIDEYFFSFFSFGNEAINVLKALVEDASRRHSEDSGQNTTHRVAVGAKSTSASKDRSSFAGEPRSLNIRENVKATLSPRSSRTRRDSSPRFSGDVTRNEFHQPGRESRGLDHPTGVNRSRGSFSRRRSLSKSHQYDSAASQELHESSDSYVQSLEDHSMSGLVASSNEDPSGSQILRGSEVFHRPIIRHSDSISRASPNQLSGKAPLEEQLVEMSHQPHHAMTTGHIDDYASGDRPDRATTPTLQNLAKMGTYPLQRAGVFANYLNQTSRRMSNLLATESMGYVEKVSGMWKGGRKHYHESPGLQIDNGADDEENSTDGKHTMAMERFRAHFALPETEKLQATYFGFLIRVLPLYGKIYISDRHFCFRSLLPGTRTKLILPLKDIETADKEMGFRFGYSGLVVVIRGHEELFFEFSQVDVRDDCAVTLLQSLETTRYLLEAGLPEDDLLEEGDEALAERDALNEARLLEGNEHELKMPQEASGLSDSSPTILFDDPKASFLNFKPPESLKIACLTIGSRGDVQPYIALCKGLIAEGHKPRIATHSEFRDWIEGHGIEFAPVAGDPGELLRVCIDNGTFTWAFLREANSHFRPWLDGLLESAYTACQGADLLIESPSAMAGIHIAEALNIPYFRAFTMPWTRTRAYPHAFIVPEHKMGGAYNYITYVMFDNVFWKATANQVNRWRNSTLGLPNTNLEKIQPNKVPFLYNFSPAVVAPPLDYSDWIRVTGYWFLDEGLDWTPPDDLREFIEKARRDGKKLVYVGFGSIMVPDPARMTKEVIDAVLKADVRCILSKGWSDRLDKARASVPEHVLPPEIFQIKSAPHDWLFRQIDAAAHHGGSGTTGASLRAGIPTIIRPFFGDQFFFGGRVEDLGVGICLKKWGANSFAKALWEATHSDRMIVKARVLGETIRKEDGVNSAIQSIYRDLEYAKSLVAAKAGKNAATAGSPDDTVGDDESEEESWTFVGGDEMDPDLAVKKGVLAEMEANVNANGMFGTGTTGTTGTTRTTATIEP

SEQ ID NO: 7669 - protein, 1433 aa, Aspergillus udagawae
MRPFLDDAKRRVDRKLSASRQSLSTSRLLPSALPDRLKDNHDAQVDFTAPPRGSSSREGHLQYMQQSIFGMIAAVGSRSDFHARFDESSDSDGETEQGTRKESSVRKGTSASANIPSLDSSQRSSSRTDGKPEKESGTRGRRHRRTISDHKLIRPFKSSSRQEPQTDPSTGDEMPSVSPSTRPRSATPRAAPILSRMVEAQAQFDLKASSTERSQSSSQESGDKGPRDASVSPLSTRLMDMFGFDKPEKVLVEYACSLLQSMLLQGYMYVTEGHICFYAYLPKKSTVAIKSGYLYKRGRKNPKYSRYWFSLKGDVLSYYADPSNLYFPSGHVDLRYGISASLSDPKEKGTEPRDFQVTTDQRTYYFRADSSMSAKEWVKALQKVIFRTHNEGESVKISFPIESIIDIEESPMVDFAETFKIRVIEDDDSYAIDEVCLSITNILHEAHGLQYFFTFFNSGREAFQFLRSLINDQSLKNYSQHLSPQPDRSLRSDRTRKSRNRWSLTSGTTRIQGNGRSETQRKRSASASHLSLAHDVIESSPATRHQDSSDSILTSFEQGTESSAAWQSMTDAAESASQILNRSDVFQSPTIHGLDRRPSGGERRVRRNSDETARSLSTRANVGTGQQIDELGRRMDGNASGREARDSTGESDQVTQDPTKSFSAAPSLNELVKAGVYPLQRAAGLAEYLRTRSKQMSNLLASESMGYIEKVSGMWTGGRKHYGEAEDVLPDDQDVDPEDKEDGCNYGDRFRAHFALPPTEKLQATYFAYLHRVLPLYGKIYVSQKKLCFRSLIPGTRTKMILPLRDIENVEKEKGFRFGYHGLVIIIRGHEELFFEFRTSDARDDCAVTLHQHLEAVKFMAESGLLAEQEQNESEAAMAEHRMLQEARFDDYGENDLRPLNESSELHPIFDDPRASIVNFKPAESLRITCLTIGSRGDVQPYIALCKGLLAEGHRPKIATHAEFEPWVRRHGIDFAPVEGDPAELMRICVENGMFTYSFLKEASQKFRGWIDDLLSSAWASCQDSDLLIESPSAMAGIHIAEALRIPYFRAFTMPWSRTRAYPHAFAVPEHRMGGAYNYITYVMFDNVFWKAIAGQVNRWRKNELGLKATTLDKMQPNKVPFLYNYSPSVVPPPLDYPDWIRITGYWFLNEGSGWTPPTALSEFIQRAREDGKKIVYIGFGSIVVSDPSALTKTVIESVQKADVRCILSKGWSDRLGDPTSAKPEVPLPPEIFQIQAAPHDWLFSHIDAAVHHGGAGTTGASLRAGVPTIVKPFFGDQFFFGSRVEDLGVGICMKKLNVSVFSRMLWEATHSERMIIRARDLGARIRSEDGVATAIQAIYRDLEYAKTLARQRSIASSTPFSPTPSAKTTAEQDADDDVEDSEEWTFVGDDTDMEMSKRQRDRAISDADMLPDRLLANPNPGDSGPGRKLSDR

SEQ ID NO: 7670 - protein, 1211 aa, Komagataella phaffii
MSQLRPRDSSAGKSSSPRRTDRNPESIDVNSKGGSEGMTSGLVPGTAPHKEDETEAEDDIDCGRLITSKSLATMLTTASMYAGVSQLDDDAIESSALDEPIPYVPYEEDAESVMSESTVGVDTVRDTDSSEQINPEIDGLVALRKKQQHTLSKFELSVVRKRCSQLSLAGSSSGSTRRNSFTLDNNETTRAVKLCEKLKTTFDLSDDDEFVNDYPCWLLHEVFLQGHIYITSRYLLYFAFLPKRDSTVTMSGALSIRSSTTMRFSVRRWAVLKGNYFRLYANSTERYFPSLNIDLRFLLKVELSNPNLEENKPTVFKLITEARTHYFQADSLDNARSWVTDLRKHIFTAKNSGGHVTIKVPLENILDLSIETLFEASQTLKLKVLESEESYAIDDYYFMFFNNGDQVLDSIRQSMKALGIELTDSDSSESDSDVSGSETNGRSTHRKSKLSRSLSVLTPIPRGIGSIYKPIKSSASGIIGAIKKPQKSATRPFSSVVETVVPNDNDSELKQDHAGDAPKDSEEPSTKPSNWSAKSLVQGFLSTTSSISQSMLFASPMHYNNQLFIERGEEDPYFVTNKEEREVAQSRFRKHFSLPDSEELLASYFCHFQKNIPVYGKVYLGTTCICYRSLFPGTNTTMILPYSDIENVYNLKGFRFGYSGLVIVIRAHEELFFEFGSNESRDDCDLFLLKQLDFTKSHKNAHSEQKRKRNDSIKLAESVQLADARLRYFETRIESDIGREVPIILEENQYSTSEIRSKRRYKFVLLTIGSRGDVQPYISLAKGLLAENHKVKIVTHEEFKPWVESYGIEFATIAGNPAELMSLMVTHKSLSVGFLKEAKEKFTGWIGELLQSSWDACQDADVLIESPSAMAGIHIAEKLQIPYFRAFTMPWTRTRAYPHAFVVPEQKRGGSYNYLTHIIFENVFWKGISGEVNKWREQVLMLPKTNLERLEQNKVPFLYNVSPTVFPPSMDFPHWVKVVGYWFLDEGEADSYDPPKPLLEFMEKAKTDGKKLVYIGFGSIVVSDPKQLTEAVIDAVLSADVRCILNKGWSDRLGKQTGVEVELPEEIYNSGNVPHDWLFGKIDASVHHGGSGTTGATLRAGIPTIIKPFFGDQFFYANRVEDIGVGIGLRKLNSKSLSKAIKEVTTNTRIIEKAKEIGKQIQSENGVSAAIRCLYQEMEYAKKLSKSKQKYWDNQSEDISDDSVSGSWFEV

SEQ ID NO: 7671 - protein, 1300 aa, Hypholoma sublateritium
MRAGTQTLIQALQALPWMNADNDEDGPTYPGSPGSADSESDDEERPPCKLLVSRLSSSIHTIHRPLARSHRINIPNASRTSFQQPVPEEESLEDLSPSDEEQDNDFEETPRLPVEVPSQLSQQVIARDTSRQALPPPGLRERQNSMATVRLHRRARLAEKLREVYDLEDIGEYMLEMPCWLLRSVLLQGYMYLTNSYLCFFAHMPSREDQILKSGSLNKKAQRTKRWIKHWFVLKNDALSWYQSSSDPYFPHGILDLRYAISCDPSGEKDMRLRTNSRTIVLSADSVPSREEWVKAIRKVIFKAQNMGDSIAIPYAAILDVERSTAMDFSETIEVKVVDKEDNFSVDSYFFAYFQDLPGGLDQIRDAVRSHRAQSSAVESRSPPVVLDTTVPKSFLTNERSNTNVQDAAKPTSGFRLSSFFRPFSDTSAIRGSSLPAPSDIQSEEYTHISRKPNSVSFVPVASPEATTSPLPQQLSESSDIPTGQSTQFLPVTDHTYPPSTSNSSILPNISSLSRDSSGSWAVGVPSWLKTPRKAFTGSSTADSSSVLNTTPVKEIYSSPISSPGPASRSSGMGDMAFSVLESPDMFPDQEATDKFRAAFAYDAKETLLGYFPGYIYRVIPISGKLYISSNYFCFKSSALTVRTRMALPLRDVLACEKSKAGRFGHHGMIIIVKGHEELFFEFGSEERRNAFVSLLERQLEDTRRRIGSGEMVATSSGKRDALILEEFDARHSSTDSESALPTDNMADSLPAVMFTSASSTFLTFKPRKALHFTFLTIGSRGDVQPYIALSKGLMLDGHKCKIATHGEFREWIESHGIEFGYVGGDPAELMRICIENGTFTVSFLKEGLLKFRGWLDDLLKTSWEACQGTDVLIESPSAMGGYHIAEALGIPYFRAFTMTWTRTRAYPHAFAVPEHKLGGSYNYMSYVMFDQVFWRATAGQINRWRRNLLHLGPTSLDKMEPHKIPFLYNFSPHVVPPPLDWPEWIRVTGYWFLDDAEVSASKWTPPASLVQFIDNARATNRKVVYIGFGSIVVPDPKAMTQCVIEAVLSSGVHAILSKGWSDRLQVKSNDPTDVEEPLPLQIYPISSIPHDWLFQRIDAACHHGGAGTTGASLRAGIPTIIRPFFGDQFFWADRVEALGVGTGVRKLTVSALSDALVSATTDPKQIARAKTIGAEIKGENGVTTAIESIYRDLDYARSLVKRHLTEDEDDEEGTAEDSTIRHRDNVSPSSPSGYSSEGSHRGTPSEDWSVISDPEDRRLSLGSQPSERQAASKRTSFGAAAISILPDLFVAGSSVTRNA

SEQ ID NO: 7672 - protein, 1552 aa, Friedmanniomyces endolithicus
MTRPRYHCSSDVDGHAKIQFVALGNGVWLDEIRRQGNADIKDVPGGSVTFATLGARLFAADCTDAIGMAFKAGHDFPESIVDIFRSWSIDLAVQWLRDSPASRGLVVYEKGNNNRKGFQRLTEPLPVTVAELQGTTLLATSAFEFFGSAEYIDDQGADIVSLRQQLGGDHASTQPFIVWEPHPKSCLPDTLSKHQHVARLVNVFSPNHEELHSFFGEPTADVDPMVIEAQAQSFVDAGIGPHGDGCIVVRAAGHGCMVLSRHRSACWLPPFYPADSDNVVDATGAGNAFLGAFAIGWQKTESYIEAAAYGTVAASFALEQVGLPMKSGEGDGELWNGCGVEDRLAEYRQRIRGKSLEDIHKVRDQRHVSMDVPERFQGEDNEEDVTGIAEDSPGYAQQSLYGLIGATHSKSGLHMQGHFHPDSGSESGGETETEGSGRPDRISSTAAGQPSDSRSNLDEQRQSPKPDSSRHRKNKSEGKGLRSFLRPIRERSDSQPPDIMTHSGFLPARGKATREPDRPASAGGMRSDAPLLDRKLHARARAEMDASTTSTSSRRGKDGSSSESTKMKATAVDLPVAVAEIFGFGEPEDIIAEYPCWYLQSVLLQGYLYITKKHVCFYAYMQKKGHATIKSGQLAKQGKRNPRYRRYWFALKGDVLSYYTNAADPYFPSGTVDLRYGVSADLVPEKGHDKSKDSALFTVTTDNRTYHFRADSTASAKEWVKQLQKVIFRSHNDGDSIKISLPLENVVDVESSPLNDMAETIRLRVIDNDQTYSVDEYFFTFFSHGKDALHLLHVLTADNENRKAPLDIADDDGQGKRGLSYLGSSPKDYYTKFSGAMAGGKRHYTEADGLAPESHIEDPEEDLDTVEHERRFQQHFALPESERLLAVYYCSLHRVLPLYGKAYVGTRNFCFRSLLYGTRTKMVIPFKNILNLEKEKGFRWGYPGMVVVIKGHGGLFFDFSSNGLRDDCVVTVLRTLEAVRALQESVILTPHEKKDADAAAAENKLLSGVRKDVHAERDADPSEILSRIESGTPMIFDDPNASILDFKPTKAMRITCLTIGSRGDIQPYIALCKGLLADGQHPRIATHREFQGWVEKHGIEFAPVEGDPAELMRVCVENGMFTPRFLYQATSQFRDWFDGLLTSSYEACKGSDLIIESPSAMAGIHIAEALSIPYFRAFTMPWTRTRAYPHAFAVPSHKQGGAYNYMSYAFFDNLFWQISASQINSWRRKHLGLKPTSLEKLQPNKVPFLYNFSPSVVVPPLDFSDWVRVTGYWFLDEGTAWTPPADLQAFIDKARADKQKLVYIGFGSVTVSDSRELTQHVVDAVLKADVRCILSKGWSDHFDKKDASVPEVPLPPSVFQIRSAPHDWLFQQIDAAVHHGGAGTTGASLRAGVPTIIKPFFGDQYFFATRVEDLGVGIHLRKITVNALGKALWIATHDDRMQGKARLMGEQIRNEDGVATAITAIYRDLDYARTLIKKREVKIEGGGEVEDTEEAWTFVENDSDGDVARLGEPEVVWPASLLQAQQSWGGGGGHRKQASLGSMVLRGGQKTS

SEQ ID NO: 7673 - protein, 1581 aa, Thielaviopsis punctulata
MPSPLRSRSGDRSSSIRHIRNASKSLVRKRPASMKPTTTATTATTTAAAAAATSQFPARLQAADDDSGEEDLTAANKQTVNMAQSIFGLVAAVGSTGNFNPPFQEQSSDDEQDESHSPGLAKTAGLSPCFVSSSLDPSCRVSSHVASPSLVPSPSLQPSSSPHSPKSPKEPLNSPKSPADPHLSPKSPTNPSHRRKISESRLFRSLSAMPRFRKESSSKKRPSNNSSSSSAAAESDANDANDADVDSEPAPVMSRILDGRAEMAARASFDIEGMMGTQSPPTAAVGEASTRPTEAPTQLPAEASTSLAPFDGNTSSSASSPSTLAQKLKDIFEFDEPEEVIKEYPCWLLQSVLLQGFMYITARHICFYAYLPKKTDKVVKAGFLGKSGRRNPKYHRYHFRLKGHQLTYHETPTDLYFQSGLIDLSYGISAMITDKDKDGTHFNVVTHDRTFHFKADSPASARDWVHSLQRVIFQSHNNGDSVKISLPIENVIDVEDTQMLDFAETVKIRVIDNDDTFAIDEYFFSFFRNSKEALDLLRCYCEKAQSKNREALASANDASSNLSPGHSPGLKPSTVSGVQSPDSSGSRAPTPSGHRHHNSLSVRTGKLPEPVKATLSPLQSPSRRRRSRDFQGAFGAQRSFSQSRTRRSVSSQRACVAGHGRHESTATSSSDVGMADLGSESRELGLGDRCTRPGERGSGSATTRERDARPIDLKASSDSYVRSLSVDESSMAMISSVEDVSLLNASATASQILHDSDVFRTLPTQNLELDGGGAGGLSQGRAEGNESPQQAGQTSTQAATEANQAQETTEANDDTSTLQGFARIGSVPLQRAGALADYLNRTSRKMSSLLASESMGYVEKVSGMWKGGRKHYSLELNAHGGGRPAVDEGVHEMDEDKIGSSNERFRAHFGLLETESLRATYFCYMMRVLPLYGKIYVSDHMFCFRSLLPGTRTKLILPLKDIETVDKEKGFRFGYSGLVLVIRGHEELFFEFGQAEVRDDCHFLMEESLEACKMHRSGCLDGEQEEGGKEEEEGEKEKETEELARTALAERDALQAERGAADNDAVAEADALQATTDAHSIPLLLFDESQPRPKPKPQTPLRITCLTIGSRGDVQPYIALCKGLLAEGHQPKIVTHAEFGPWVQSHGIDFAAISGDPAELMRLCIDNGMFTWTFLREATSMFRGWLDDLFASAWKGCQDSDVLIESPSAMAGIHIAEALQIPYFRAFTMPWTRTRAYPHAFAVPEHKMGGAYNYMTYVMFDNLFWKAIAFQVNRWRRSMLKLPSTTLEKLQANKVPFLYNFSPAVVAPPLDFSDWIRVTGYWFLNEGSGDSWTPPPDLQAFIDRARADGKKLVYVGFGSILVNDPGRMTQEVIDAVLGADVRCVLSKGWSERKTDSQTAAAAAAAGGAATSTKTPEPEIPSDIFVIKSAPHDWLFAQMDAAAHHGGSGTTGASLRAGIPTIIRPFFGDQFFFGSRVEDIGVGVCLKKWGAKSFGRALWTATRDERMRRKAAALGKSIRAERGVATAIQSLYRDMEYARGLIAAKTKRDGRREEEAEEGEEWTFVGTDEPDPEVVTQRLSEM

SEQ ID NO: 7674 - protein, 884 aa, Trichoderma reesei
MLLSRTRSNAAGHIAIDDGLKKQITSVGEDGRFELCFHDDAGSLATWCKNLQETSKRVQTNPCSVPGICRRKSTGGFCPPLNIAILIVGSRGDVQPFIPIAQLLSKPPYGHRVRICTHPAFKDFVESQGVEFFNIGGDPEALMSYMVRNPGLVPSRKSVRAGDIGKRRAEMWEIINRAWRGCIEAGDGMGDPVRATDVENVEDLFLADAIIANPPSIAHIHCAEKLGVPLHMVFTMPFSPTTAFPHPLASMNYSGADAKTANYLSFIMMELLMWQGLGDLINKFRRQKLGLDPISVMWGFQLLSRLRVPFTYLWPESLIPKPPDWGKHIEVVGYSFLPLAKSYTPPPDLTAFLEKGPRPIYIGFGSIVVEDPDAFSELLFKAVKIAGVRAIISRGWSGVGDKCRITEDVYLIDNCPHDWLFQHVSAVVHHGGAGTTAAGIAAGRPTVIVPFFGDQPFWGQMIARSGAGPDPIPFKSLTAENLAESISVALTPSVQEAAKRMAEDIADENGAEAMAKSFQEQIGLDQFECEICPGRLATHRHKKTGTRLSGLAVACLVDRGVIQPAELELIRRKNWYVDEGAEHPLVGLAAAFTGPMGDVATATFDYSHALRYRPKHTKVEDRRPSWIDPWATDNSTNGSVGSNVASPNRRINPTTFSTREMELYAHKIARRSLKTNNADIDTLIRQPSLYDKQKAAWHARERGRNGQLFYLTRATGRYAVELTKVGLKAPVAFFYNIANGFHNYPSCGYAGVEVRRRDQIIDFETGLVAAAKEFTLGIWDAFSGVIILPYKSVHEEGAKGLGKGVWRGSKGFFSNLGASAFGLPGYALKGMEKELQKHHLTNCKAEMILIRLRQGIEAFRRATPQERDEVVRRWKARGCTQKQS

SEQ ID NO: 7675 - protein, 1424 aa, Fibroporia radiculosa
MSEEHDADTEGVSVGPAEKRSGDATESKSRFVKRAIEMTADKLTRSKSAGNKSQLSQSQPSLPAQTPSRILSLRNRGKGKEKSNGSSSPGEGDPSDFHSQLLPSPRLNERSSATYRRQMRPASSRSKDDDSPFITPRSPSLGPKRPELQTFRGTGSIRAGTQALIQALQAVPWTDYQDEEEYLAQDNAPLDSSSDEEDGSSGNRMASSIHTIHRPVARSKRGESTCSIARAPGLPRVPDNEELPRLEEQILSEEDIDDDFEPEQPGPINSQSLDIEDGQRTPSQSPEDTDMSPTHPARRSLNRSGSLSTVKIQRRTRLAEKLRDIFELDGIHEVISEMPCWLLRSVLLQGYMYLTDSYLCFFAHMPSKEDQVLKSGSLSKKAQRTKRWIRHWFVLKNDVLSWYQSPSDPYFPHGIVDLRYAITCESVGDKGIRLRTNQKSIRLSADSTPSRDEWVKALKRVMFKAQNMGDCVRIAIPYSAVADVDRSSAMDFSETIEVKVVDKGDQMAIDSYFFAYFRDLPLALEQIRDAVRMNRGISSDTLIPTVLDTTVSRPSASTSTPRTQSLPAPESTPKSSSGFRLPSLLRPLQEGLPLSRPGVTAERSDSEEFTHIAKRTTGSFMPITTSPISSMYSATERSRSPEGGAPSSEEVADESLSGSHHTYPPSPSPSPSLSELTVSPSRDSSISSWGVGVPSWLRMPSMPSRRTLTSAFGAYKTSPEQTISSTEGSAEGVSEVLSSNAGSGSRMSSGSGPVDFGYFSILETPETTLDVETVEQFRVSFAFDEKESLLGVFPGYIFRLLPVYGRLYISTHYFCFKSSGPLATRTRMVLPIGDVLSTEKTKAFRFGHHGLVLIVRGHEELFFEFADHERRDAFINLLERQIEDVHRRSQAGDPCRRDTLTVEESGPRSSFDNDNMASSALPAVMFNSTSSTFLTFKPKESLHFTFLTIGSRGDVQPYISLAKGLIKDGHRARIATHGEFKEWIESHGIEFGFVGGDPAELMRICVENGTFTVSFLKEGVMKFRGWIDDLLKTSWTACQNTDVLVESPSAMAGYHIAEALKIPYFRAFTMTWSRTRAYPHAFAVPDHKMGGNYNYMSYVLFDQVFWRGTAGQINRWRRNTLNLPGTSLDKMEPHKIPFLYNFSPVIVPRPLDWPEWIHVTGYWFLDDANVSSHKWTPPADLLDFLETARKAKKKVVYIGFGSIVVSDPKAMTRCVIEAIVRSGVYAILSKGWSDRLVKNVADAPEPEEPLPKQIYSVSSIPHDWLFQRVDAACHHGGAGTTGASLRAGIPTIIRPFFGDQFFWADRVEAMGIGSAVRKLTVESLTQALITATTDQRQIQRAKAVGEQIRNEDGAATAIEAIYRDLEYARSLVKRGPAVDTEDEDVDAERATIRDYPSSPERSGTRSASSSVSSARVSDWSVISE

SEQ ID NO: 7676 - protein, 1478 aa, Pestalotiopsis fici
MAPTPPDIRPSNEEATRRRVSKKLHKKRREEHQPTMELPDRLKETGDEVDEDVVPQQGGQQMFMNMNQSIFGLIAAAGSTVDFNDRFEEQYSDEDEAGDQRPEAKKAKGKEPEREDVATSQIPKKTSPEKAEKTDKKHRRRLSSQLLHSLPQLPRLSSKSRSRSSKLNSPSTELNAGLKDAAAHHGTFSEAGSSSLQSPNIEITGNDRDSRAAPVMSRMLEARAEMAARPSFDLERLSSDLRRGSDPGDNEDTELAVRLKEIFEFDQPEKVLEEYPCWLLQSVLLQGYMYITARHICFYAYLPKKAHEVAKSGYLSKSGKRNPKYNRYWFRLKGDVLGYYRDSSNLYFPSGQIDLRYAISANIVDKEKDGVHFSVVTEHRTYHFRADSAPSAKEWVKSLQRVIFRSHNDGDSVKISLPISNVVDIEETQMLEFADTIKIRVIDNEETFAIDEYLFSFFGFGKEAVNVLKILVEDAAEQQKEKQSELDVPGMQGRTGTSSDRSSLSASRTEAPSGELRSVKVRENVKATLAPASPSSHRESMSRGSGELSRGSFDGFRPFARRSLDMGSPTHGGSARRSFSGSRSQSRARTRITKVPQENPGSSDSYVQSLEDPSLSNMVASSSEDQTGSQILRDSQIFQRPTIYRRSTSGSRLKPIDDDASQPKEGLPSYRPRHAATTGYIAEPASDEKLHPAATTPTLQNIAKMGSYPLQRAGFFADYLNQTSRKMGSLLATESMGYVEKVSGMWKGGRKHYHDPNALRTDEEMDDEDDEGGQEATEVQLGKTMQRFRNHFALPETEKLRATFFGFMIRVLPLYGKIYVSDRYFCFRSLLPGTRTKLILPIRDIETCYKEKGFRFGYSGLVLVIRGHEELFFEFNQVEVRDDCNITMLKHLEAMRYLKDSEFAAKEDQEQVDDALAERNALNEARLKENTEHEVQLPQQASFLGDASPTILFDDPKASFLNFKPASSLKITCLTIGSRGDVQPYIALCKGLLAEGHKPRIATHAEFKDWVEGHGIEFAPVAGDPGELMRLCIQNGTFTFAFLKEANTTFRSWLDELLVSAYEGVKGSDVLIESPSTMAGIHVAEALQIPYFRAFTMPWTRTRAYPHAFIVPNNKMGGAYNYMTYVMFDTVFWKAMAGQVNRWRKTTLGLPPTNLEKMAQNKVPFLYNFSPSVVAPPLDFSDWIRVTGYWFLNEGTDWTPPDDLRQFIEQARKDGKKLVYVGFGSIVVSDPAKMTQEVIDAVLKADVRCVLSKGWSDRMGSESSVPEPELPPEIFQIKSAPHDWLFTQMDAAAHHGGSGTTGASLRAGIPTIIRPFFGDQFFYGARVEDLGVGICLKKWGVASFARALWEACNSDRIIVKARVLGEAIRKENGVDTAIQAIYRDLEYARSLVVAKAGKHQASKQSKEAVSDSVSEDEEEEESWTFVGNDDDFETEVIASKSALVEAEQLAKESSKSTSLASRIIGSTTTSNAAATSKA

SEQ ID NO: 7677 - protein, 1192 aa, Brettanomyces bruxellensis
  MOD_RES (968)..(968): Any amino acid
MLNVDFPSIQIGDNNVYDKSSNTNRDRRSRRDKQGKSRFSRLSFSPSHIWSSLSPVRGGKTGDKEAANQSEDVNTKASSDTGGLQSDIKSATRSRRTTDASTSILGISRSFAGFLTTASVYAGFEDLQEAQQEENEIIDSEAADYGGTKQSKNTIYSKSTASKSKLELSITIHKPLLSKEKARMFAEMLRQRFKIPDDCEFVSDYNCWLMGDVLLQGHLFITTQFVFFSAYLPKRQPEKIIQQGTLSVKSAILHRRWIILKEGTLSVFSHSNDLYFPDMVLDLKAALRAEIYHKSKKSGIGKEKTSESAPVWFKVLTPKKTYWFQADSMSSARSWVSAIKKQIFQSRNKGDQAIVKIPLRSILDFELTTVLGETKNLRIKVIENADSYAIDDYFLLLFSDGAKVAGDIRNVVDRAGVKLTDGRNEEECAQFVKRKAELMKEINEGIETSNCMIRDPESIQKETKKIKDESQLESVEVQSPNSATSSTFQRVSKAAASGISTITRNLSYKQQQIVHVGSEFVGDPFYILDKTAREKKQSGFLKAFSLHDQELRAIYHGYCLRGLPVYGKVFISTDYLCFQSSLPGSGTLMILPLTVLENASKEKGFRFGYCGLVVVIKGHEELFFEFSTEKARDDCECQLLRQKDRMRNNDKRRHRSYKGSHASTSTASHSNSPESSESAPTLTSARIKLVESKLNDEIGADVPILIEDNPLQRTVLKPLRHYRFTLLTIGSRGDVQPYIALGKALKKEGHSVRIVTHGEFEPWIKSHGLEFAPIAGDPSELMSLMVSHPTISYSFVREAKSKFSSWINELLDTSWKACQGTDVLIESPSSFSGIHIAEALGIAYFRAFTMPWSRTRAYPNAFMVPDQKLGGSYNYMTHVVFENGYWRGVSTQVNKWRENTLHIPRTTLAALKQNSVPFLYNMSPVVFPPSVDFPEWVKVTGYWFLNEGHDDYKPPEKLKSFIKDARRXHKKLVYIGFGSIVVEDPHKISSVITQAVLRAGVWCVLNKGWSERGKSKRNSQRTDSSENPRDTSRKMDEFPPEILSIGSIPHDWLFPRIDAAVHHGGSGTTGASLKFGLPTVIKPFFGDQKFYANRVEDLGCGIALKELTVSSLASALKEITTNNRLMQKAEAIGSMIRKENGVQNAIAAIYSEMKYAKNLSLQKRRVSVADDDKVECKLDEVTSEDGESWLLV

SEQ ID NO: 7678 - protein, 1316 aa, Claviceps purpurea
MEEGPKQKEQHQSHGRTRQRPRQKVSNSTSDGAESLVADGLMVASLETSSDDALPPAYGEHHNHIKFSQPGIDAGAEATGKNSLRRDPRVNGSNQWTSRSKRGGINTYANFEHLRPMLTDDGIPLALDDGRININICTKNRRLADLLAPEIDSRTFASPALPPAYIPPGLGAALGQPPLPVLNVVIQIVGSRGDVQPFLALGKVLKETYGHRIRIATHATFKSFVEENGLEFFNIGGDPAELMAFMVKHPGLMPGIDALKSGEITRRRRGIEQMLLGCWRSCIEAGDGMGPPPKQHRVNAPLDFSQSLPGDERARPFVADAIIANPPSFAHIHIAEKMDTMTWQGLGDIINRFRKRALELPALSFVWAPGSLNRLKIPYTYCWSPALIPKPNDWGAHIDVSGFCFLDLASSYIPDPDLAAFLEAGPPPVYIGFGSIVVEDPNFLTQMIFEAIRLAGIRALVSKGWGGLGAEDRGNPESVFMLGNVPHDWLFERVSAVVHHGGAGTTATGIKAGKPTLVVPFFGDQPFWGAMIAKANAGPEPILYKDLTAEKLAEAIKICLEPNTLARAAELGTKIRKEAGTDVGARSFHRHMDIGNMRCSLAPSRVATWRVRRTKVRLSPLAMSVLVDAGLLEYKDVKLCRHVEYNTEDQPSDPVTAGAIAIIGDMSDIGLAIADVPRKLFQTRRIKDPQGFEMRNVAKAPTEPTPASKGVVSQTASMKADVWNKAVHRGDHSATVTADSNQPLLHHPSDPRPSHELLTNPTSATAFNKQTASAADCMAQSIIQSMTRSSVDKTQSAGLRREPSPSVVSLDTTIAAGQSLGRAVSTGVKVPMNFALGLAKGFRNMPRLYNDDTVRPSGKVTDLTSGIRLAGKELGLGFFDGITGLVTQPIRGAGKEGASGFVKGIGKGIGGLIAKPAAGIYGVPAYMMQGVHAEVSKMFSTSFTNYVITSRIVQGDQDRVGAGEEEKAEIIIRWNNIKPDLKHFHVLKRTERKKAQKAKMGAAVPSHTPVFPSSQLKAPWPHGQNLPSEGKQKLVARERDSSSSTIAIAASNEFGVTPSLVSGDVDYETAIQASVRETSRGDREEDAVIEAAIRKSIEAMRAHARARDVLLDPLLNASELLVKDASIFHDEEYRISDEEYQDLIERAVQQSLASQILDYDSDQDFGTTAAGTSTSAAGLASDGVQEGFQHGADIRRAIDDSNNIEYLLHEDYEASLQQAIELSKQDLDCYQTRRNEEDIVLEYMKKQSLAEKEYRQNMDEHREKWVVYNGGGDEDEELRRALKATEVSSKLHMGNDTGTSVRDANNEDQTVGTGSE

SEQ ID NO: 7679 - protein, 852 aa, Rhizoctonia solani
METYPSDARIRRSTASHYSQSHRNQSRTLSIDTPSFSSYNATLSRAQDDYNARELENSSLPYYRYGSMPHESRSPHSQRESVYSKPDEETLVGSVTSFDTVHPTLGHHPELGVEASFHNNGRLSMVFNHRFDKPLPEIYNAPVQEVGIDEAGFAHAPPMSVNIMIVGSRGDVQPYVALGQRLQKYGHTVRLSTHETFRKLVKDAGLRFYNIGGDPQELMSYMVRNPGLIPGFKSMTNGDIGKKQKMVAEILEGCYQSCIGPDDDTKAIFVADAIISNPPTFAHIHCAEALGIPLLLSFTMPWCPTTAFPHPLVNVLQRGSTEANVLNYYSYGLVDLMTWQGLGRTINKFRTRRLGLQYLSSTSAVGMIERCNIPWTYCLSPALVPKPTDWMNHIDLVGFYFLDLAKDYQPPQDLVDFLNAGPPPIYIGFGSIVLDNPMRITETILAGVAQAGVRAIISPGWGGLDENMIKSAGQHVFALGNVPHDWLFQYVSAVCHHGGAGTTAAGLKCGKPTIIVPFFGDQPWWAAQIARRGAGPSPLDHKKLTSDIFASAVQVALSPSSLGAAREVGKMIMREDGAEKGVESFHRHLPLLNMRCDLTPNRVAVWYSAKYKLRLSVFAAQVLAEAKHIKLKKLKLHRSREYNPYVEAVDPVTGTVIPALRSLNNMGRGLVKVPTKPGKGIAQFTRASVRGVQGTLQGAAEGISNMPKLYGSEVREHKRVTGIGSGIAQGTKGLVLGVYDGISDFVTEPVKGLKNDGFYGAIGGLGVGTLNLVTKPVGGALQFVSMPMEGTAISFSHKEIEKDRIVARQAEGIVASERASLQERSAVIEAFVEYKAKRKRDKKGKNKCKTAA

SEQ ID NO: 7680 - protein, 1473 aa, Sporisorium reilianum
MGLRPLFGSRASVNNVRDSFGTTVEQVKSSESEHADPLNQAASNQAVSAEQPHQPQDRQGLAGLLNAAALVSDKDAQSTTEDHHDHDDLVAAQPQHTPQPVALDASHDDAAAWKQSRTEAETSDQRESARASSKFGRTLKKFDAKIRTKIGVNPPPTAQEIKSPYSIGNDEHLTSHNHEGAAELLNDAQLETLQHLSDDDADDDDDDDQDEEEDDDQDHQDHDATQPDAASIQKHVDELERTKKDAEKRRSGSMDGARPGDTVRTHAPAQVSAEDKMKAIIEEFGECPSLSQPNEPEKLLVDHNGVLMKTVLIKGSLFLTNRRLCFLAYIPNAARGGSEHDTPSNTDSAPGGMRAPHDPNVQNPILKSGPAVIHRPGKMRAKRRVWIELRRHSFNAYAASNKLYKPLLSARLSNLSAVLPIDWAHPNVIRFVDGSKDSSVEFKTQEAALDWRKELEAAAFHSRNTSDKVRISIPLERIVGLGAADFMQVAKVIHVDLIVGAVSESEQAQFVQEHRERAERRQLDHSWSGNDVFYNCPKDPGFKCHTTQVAFGITHNRIAFLDLLREAIKKPQTLHKSAGFRQTLQAVPAPLLDLDTDADAEETSTDGNSSSDDQKLSLAEKFCRAFGLPDHAEQLHIVKAELVRTLHTHGTLAIGLDYLLFWRRAVSRDLKVKVPLNDLQGVDTYRSMLWHHFGLVVHIRAHSDMFFDFTSKQNRDLVLSTLKRVVEAKQTHKDDAERASVNTASDGSHATKVEAGDASAKAGGKPPASVLLNDSVGEVPVFEPEVLSYLPRVVNLDRDTMRNALRVSPMRIYCLTIGSRGDVQPYIALCKALKQHGHTPVIVSHPEYRGWVEGHGIEYRGVGGDPAALMKLSVEHRIFSPAFFKESIGKFRVWLDELLRECWEECQGADLLIESPSTMAGIHVAEGLGIPYFRAFTMPWTKTSAYPQAFSVPSIEMGPSYNSSSYTLFDQIMWVATSGQINRWRKHMVGIGPTDWSKLDAGSVPFIYNFSPAVVPMPNDWGDRVKISGYWFLDNPENNWTPPKEMSDFLERARKDGKKIAYIGFGSITIENAEEVSGNIMQAVRSADVRAIVAKGWSGRGGSKPKKKKPHMQHHNSSLSHTDAEDTATEDEQHEVEIPDDVFVVDSVPHDWLFPQIDIAMHHGGAGTTGASLRAGLVTLIKPFFGDQFFWANRVQKLGAGARVNGLSVSDLTDSLKSAASDRVMVEKAQGVGEKIRSEDGVSIAIEFLYKNISLANRRTQRRLEREATAHPASPSDAQCSNPLSRLASHGRQNSGERHPHRAASLPTESLSPSPLSPSQEAGLHRSTSTIVESPAGEDGDTPTGGTDSPTKTGKSLLPSMSTLNMLPSSMAASLKEMVTLNHNTNDTTADGEEAPGSGLGDRSRTAPSGALVGEETEEQKMARLKGYKNAKAEDIRRRKLLLERLEREKRKKVEQQRKEAAEKKADAAGVQA

SEQ ID NO: 7681 - protein, 409 aa, Streptomyces yokosukanensis
MTAGSRGDVAPYTGLGHRLALSGHEVTLVTHARFAPLVAGSGVRFHGLPVDPLAELESPRGRGLHRSASEAGKLIRLAGMARRVVGRMTEDLITAARDSEVLLLSASLAPLGHTIAEGLRLPSMGVYLQPIAGTREFAPPVLGGGSWGPAVNRVAGDGVCLATEHIFTGALPGVRRRLGLPAVRAGATLRTRERRLWPVHHGFSPLVVPRPRDWRAGLTVSGYWWPYDAASQLPDSVRDFIDSGQPPVYVGLGSATVPDAGRLSARLVAALRRAGLRGVIQRGWGGLTADGDDMLAIGDVPHALLFPRMAAVVHHAGAGTTAAGLRAGVPAVPVPVQFDAGFWSARLVALGVAPDVVPLRRLTVQALASALVRATREPVYRERARSLGARIRAEDGAAPVLAALDRLGD

SEQ ID NO: 7682 - protein, 500 aa, Colletotrichum fructicola
MGNQDRETFDSSRASKASAYGLEDLYIEDEPSTSQPPQTPPAYTPEYTPQKMFPMPLNIVIQVVGSRGDVQPFLALAATLLKSGHRVRIATHPQFSSFVLANPNLEFFPVGGDPADLMAYMVESPSLIPKVSQIRAGIIQRKRDMYTEMLDGFWRSCVHPDPLTNVPFVADAIIANPPSFAHVHCAQALGIPVHLMFTMPWSSTKAFPHPLANVGYSKEDKKSTNFASYAAVEFLTWQGLGDLVNAWRVASLGLEPVPSTEGHRLLEVLQVPFTYCWSPSLVPKPSDWGSHIDISGFFFRDPAPYTPDTDLEAFLRAGPPPIYVGFGSIVVGGIEGLMTMVLSAIKATGVRAIISRGWSNLTGEESSDVFYVGDCPHEWLFQQVAAVVHHGGAGTTACGLRYGKPTTIVPFFGDQPFWGAVIAKAGAGPDPIPYRSLTSQKLIHAIRYCLSPDAVTAARQLAESMEKENGVQSAVDSFHKHLPQPKMQCDFFPDQPAALM

SEQ ID NO: 7683 - protein, 1190 aa, Saccharomyces eubayanus
MPITQIISASDGEAGSKPTISLVLDNLSKLEKLSPRHHRLSKSLSKIKRWRNRSNSGSSMDSSEEQDKLGEAYNDNDNADDLAKSKYMMKSIAGLLTTASVYAGMNTAQEVSALAQDDFQELGSSGLSQANLGKNEVKSKKENSKRKSGPDVPRVDKRNPTLFDFSVTRGKISKDSISKLRQRFHLDEQEPFLNDFPAWLLKDVLVQGHIFITMKHFLFFAYLPKNPRSVKMSGNLNIRTKLIRSTRYWCVLKNHLFSMYTSSTELYFPVLTIDLRETQKIEIEKHSLNGNTTKTFKLSTNESTFKFNADSEFSAKSWVNALKKEQFAAQNSEDNSISLKIPLPNIIEIDDQPIVNKALTLRLRALESSQTYAIDDFMFVFMDGSGSQVEDSLCQQLALLQKSGVSTLYNDTSAKNVKSGNQKGDLMTTEQENDDNKNSKYLNLLSSTVPSSENGKKSKSRFRERSNSWFRRAKPLEDSQVEDVEEIYKDIADDIDSSVYSTIQVPDQGDNQDQTVDWKPSHLRNFADMWAAKPIHYQNKYLEFGKDDTYLVKETEELSANERFRYHFKFNKEKSLISTYYTYLNRNVPVYGKIYVSSDTVCFRSLLPGSSTHMVLPLSDVETCYKEKGFRFGYFVLVVVIHGHEELFFEFSTEVARDDIERILLKLLDAVYAGSGEGSNASTTSIGDVQHNTDSAKLKLFEDKINAEGFEVPLMIDENPYYKTSITPNKSYKFGLLTIGSRGDVQPYIALAKGLIKEGHQVVIISHSEFRGFVESHELQFEEIAGNPVELMSLMVENESMNVKMLREASSKFRGWIDSLLQTSWEVCNRRKFDILIESPSAMVGIHITEALQIPYFRAFTMPWTRTRAYPHAFIVPDQKRGGNYNYLTHVLFENVFWKGISGQVNKWRVETLGLGKTNLFLLQQNNVPFLYNVSPTIFPPSIDFSEWVRVTGYWFLDDKNTFKPQPELENFISEARSEGKKLVYIGFGSIVVSNAKEMTQALVDAVVEADVYCILNKGWSERLDDVAAKKIEVGLPKNILNVESIPHDWLFPQVDAAVHHGGSGTTGASLRAGLPTIIKPFFGDQFFYAGRIEDIGVGIALKKLNSQSLAEALKVVTTNKTMKDRAELIKKKISKEDGIKTAISAIYNELEYARSVTLSKVKNPRKDENIVDPTKLPSAETTDEAWTMI

SEQ ID NO: 7684 - protein, 1293 aa, Pisolithus microcarpus
MRAGTQTLIQAIQALPWVDDPENDDDLGAASTPSVDSDEDSKRHVASSIHAIYRPVAWSRHMGSSVADRSAKQRSVQGEVSREVDSETELNMHFEEDVDADDFEATTPRPDDIRKHEVPLPTVAAELNASLRRRAASRTGSMATVKVSRRARLAEKLREIFDIDVLREVWAEMPCWLLRSVLLQGYMYLTNSHICFFAHMPSREDQILKSGSLSKKATRTKRWIKYWFVLKNDALSWCQSSSDPYFLNGIVDLRYVIACEPVGEKEMLLRTNQKNVLLSADSVPSRDEWVKAVRKVMFKAQNMGDTVKIAIPYSVILDVEKSTAMDFSETIEVKVMDKESSDSYFFAYFHDIQAALDHIRDAVRAHRALAPVSPQAVLDTTVKPPAGVAPGIDRARSLPTSDTKGATPFRLSLLLRPFHDTLPLPIGRMHSSPEPPNGADEYMHVSKRDTFIPITASPQSYSGNELASPATSNSTPSIPANNLTLVRDHTYPPTTSSIESSTPSPTRILPSGVPWNMGVPSWLRGARKTAGSSVSTTGVGSTPTTSQSLGGVREIYSAPWHSSSDQPLWAATELGYSVLETAEAVVDSETTEKFRTAFAFDDREALLGHFSGYLFRLLPVYGRLYVSSNYFCFKSSGPLTPKTKMILPIRDILNVEKSRATRFGHYGLTVVIKGHEELFFEFGVEDRRTAFVSVLERQMEDLRKRPSSNDVPKLSQGKRDALILEEFEARNSASSDADPVPPSEALSESLPAVMFTSASSTFLTFKPKESLHFTFLTVGSRGDVQPYIALAKGLIADGHRCKIATHGEFQAWIESHGIEFGYVGGDPAELMRICVENGTFTVSFLKEGLLKFRGWLDDLLKTSWEACQGTDVLVESPSAMGGYHIAEALRIPYFRAFTMTWTRTRAYPHAFAVPERKMGGGYNYMSYVMFDQVFWRAISGQINRWRRNLLHLENTSLDRMEPHKIPFLYNFSPTIVPPPLDWPEWIRVTGYWFLDDADVGVKKWAPPQNLISFIDTAHQAGRKVVYIGFGSIVVSDPRGMTRCIIEAIVQSGVYAILSKGWSDRLHTKTSEACEPEEPLPKQIYAISSIPHDWLFRRIDAVCHHGGAGTTGASLRAGIPTIIKPFFGDQFFWADRVEALGIGTSVRKLTVENLKDALVTATTDQKQIDRAKLVGEQIRSENGVATAIEAIYRDLDYARSLIKRPPNVEESEEPSTLESTGSRSRYDSGGSQRGSEDWSVISDPDETRASFGSRRSDSTSLKRNSLAAAVMSVLPDALTSSNHRRSNSASSRPP

SEQ ID NO: 7685 - protein, 1249 aa, Scheffersomyces stipitis
QQSILDNLNPQLIKEGLLMRPKEGQQTEANEKSRTDRLRLSIADKLQRVFDISDDDYFYGNYSAWLIRDVLLQGHLYLTRDSILFFAFLPKRYSVTSESESNYDDSNIVVQSGTLGLKTGKYGDSMFTTVLTHRYWAVLRSETLSIYSSSTDLYFPKVVIDLKTCIRAEIADKDRTEIVRGSSPPRTPRVGSGTATHSPISRRGSGDNSTDEEIEISNILAQESIAVSEDNFENASTGVWIKLITKKKNYKFFCDSLFSARQWCNNITKLIFQLNNSNAGNEVLLKIPIEDIVDYEKSKLFEEDSKDSNVPEDEIPVSMSFSKKLGAFDMSKKRSSSSASLNSDGQSSLDHIFFMFFRDGHSFYESLNAVILDHKNRLNEQSEASDSSDKFFEKAKKIPPQILSPTSSTNRIKKLGRTLSNPAKLLTISRRSSEDSANSERSLNDLDFISSPDLYVSNQQLNFPRPLTISGLKSMQMSFETSQKDPNEAESEFKKNEVKDFIDDEDEDKSLMAIGKSIKAFSKVGSKWSAFPAHFAEQDGIDDDFFVQNQEVRELTERHYQEHFSLNKEKKLVATYYAHLQRSIPVYGKVYLGDTDICFRSLLPGVQTKMILPLSEVVNCYREKGLKLTYSGLVIVVNGQHELFLEFSSQKSRDDCEFMILSQLEKLHGGETWAPSPHQWGSNYEMELTKTRLMTGVEDHPTEFSFSEQDLKRARTRIENARIKMFEDKFNAAAGLDVPIILEDSPLFKTEIKPSTSYNFTLLTIGSRGDVQPFIALGKGLMKEGHNVTIATHAEFEDWIVKHGMKFKLVSGNPAELMSLMVTHGSMSVGFLKEASSKFRGWINELLTSSWQACQGADILIESPAAMAGVHIAEALGIPYLRAFTMPWTRTRAYPHAFIVPDQKKGGSYNYLTHVMFETVFWRGISGQINKWRVKELGLPSTNLFRLQSTKIPFMYNVSPTIFPPAVDFPDWVKVTGYWFLDEGAAADYNPPEELIEFMELANEDGKKIVYIGFGSIVVKDANSLTRAIVEAVLDADVRCILNKGWSDRLSKNQSEPVELPPEIYDSGSIPHDWLFPRIDAAVHHGGSGTTGATLRCGLPTIIKPFFGDQFFYASRVEEIGVGVGLKNLNARSLSKAITKVISDLKLIERSKKVAEKIKRENGVMTAIETIYSELEYARNLILSKQQHNENYRLHMGTPSGIQSPNVEEDDEYTDTEKEEDEEDYTDESEDEGGDDYEAHEDNFSINNN

SEQ ID NO: 7686 - protein, 1423 aa, Neonectria ditissima
MAPPSDAGPVRPSVDDEDIKKRVSRRLHKKRREDRTSTVFPEPLRDSDDSAEEEDTPSQGPPQFMNMNQSIFGLIAAAGSRVDFNDRFDGISSDEEEGHETTQQGTPTDDLSKTSVLKVSSKDKSSRRKRLSGHKLLRSLPTLPKLLPKRRQSSRLSAPKEETEESSEASASGTSTPPTFTLTRHDSRQAPMMSRMLEAKAEMTSRPSFDVERASSDVGRSESTDLPPLAKKLMEIFEFDTPEQVIEEYPCWLLQSVLLQGYMYITSKHICFYAYLPKKAHDIAKTGYLMKSGKRNPKYNRYWFRLKGDVLAYYRDSTNLYFPHGQIDLRYGISSNITDTDKEGLHFSVVTHHRTYNFRADSAPSAKEWVKSLQRVIFRSHNDGDSVKISLPIVNVIDIEDTQMIQFADTCKVRVIDNDETYAIDEYFFSFFSFGKEAINVLRILIEDASGSRDEDKVLGRQEKASSLPPSRRSPPLAARHSIHLDKIRTGKLPEQVKATLSPMSPHSPGLSPRVSSDVPYRASLDAFRQIGRKSLDLSGVIREQSPRRSFSGTRRHRDGNQTPKQEQDSTDSFVQSSIEEPSLSILAASSNEDPSASQILRGSEVFHSPTMRRSASASRAADSKKPTPRNSSAQYVPHRVQHAATTGSLSTQPDSVDAQRPGTPTLQSITKIGAFPLQRANAFAEYLSKTSQRMGSLFATESMGYVEKVSGMWKGGHRHYDEPAGLRTDDDDLEEDADGKVQISMDRFRAHFALPETEKLQATYFGHILRVLPLYGKFYISDRSFCFRSLLPGTRTKLILPLKDIETVHKEKGFRFGYSGLVVVIRGHEELFFEFGQAEIRDDCAITLLQSLETTRYLEKSGLLDQEELEEENFAIEERDALKSARQDEFADHQLELPHHSSGVSNAPTILFDDPNCSSLAFKPQTSMKITCLTIGSRGDVQPYIALCKGLLAEGHKPRIATHGEFQGWIESHGIEFARVEGDPAELMRLCIENGTFTWSFLREANSTFRGWLDDLLDSSFKACEGSELLIESPSAMAGIHIAEKLGIPYFRAFTMPWTRTRAYPHAFIMPEHKMGGAYNYMTYVMFDNIFWKATAYQVNRWRNKTLGLPNTSLEKMQPNKVPFLYNFSPSVVAPPLDFSDWIRVTGYWFLDEGGEWEPPKELQDFITKARADGKKLVYVGFGSIIVNDPAKMTQEVIDAVQKADVRCILSKGWSDRISSKEDPSKPRAEEPAMPDAIHVIKSAPHDWLFRQIDAAAHHGGSGTTGASLRAGIPTIIRPFFGDQFFFASRVEDLGVGVWVKKWGTNSFGRALWEVTRNERMIVKARVLGEQIRSETGVDTAIQCIYRDLEYAKSLIKRKAGKNTEADPAEDDETEESWTFVGRDEPDPDHVTKKLSDGLMGPATSSEKSLGSQVMTSPAVAI

SEQ ID NO: 7687 - protein, 1229 aa, Spathaspora passalidarum
MRDNLPMESPQQKQYLRVQIANKLQRSFHLSEHEYFLGNYNSWLIKDVLLQGHVYLTSDSLLFFAFLQNKDMQNEESTNVAINDDSLSIIQSGTLGLKTMRYGDTLVSGMLTHRYWAVLRQDTMSIYSSSTELYFPLIVIDIKSCLYVEVSNKQKYEKEAVSPVGRGYAGYGISRQNSGTSTPRDSDDVSSDLRDLLQQEASEETVESSSSHVWIKLVTRKKTYRFQCDSLFVARKWCNNLTKLIFHHNNTNSNSEVLIKIPHSNIIEYNQFAIFSEDQDEEDKIEDEENDIPFGWNVKYYSNNESRSTRLKKKFTGEDESLETESIYFLFPKSGSNFFNEFEKIVQNNQQQVKKESSSELVRTLSETFKRSKQDDSRKQLGKSISTLTPSLNNLVQSVLNANGMDSDSILSQQSSEKSTAKKFGSTLVNATKIFAPKKSPSVIINESSDDNNDIPEPKNEQNNFCLPKNLSVGGLRSLDILLETSIKQMGEAITRYDTSNSAKSQEELFSTISRDSSQTKGGGYGPSAITKALTVFGSKLRPIPSHYQSFSDNDSYYIKQLKVRERDQNNYRETFALGEDCKLISSYNCYLQRSFPVYGEFFIGETEICFKSSLPGLSTKMIVPIFDIEAVKKEHGIRLAYSGIKIICKGREEMTLEFNLGSSRTDCYRVLCQQLNYTNDETNDSIDRHIDDTEASSMNGDNYHIPSSLEIARKRIEMARIKMFEDRLTTASGLDIPIMLEDSPFLKTEMKPSASYKITLLTIGSRGDVQPYIALGKGLIKEGHKVRIATHGEFGPWIKKHGLEFKEIAGDPGELMSFMVNHSSMSVSFLKDAQAKFGAWITKLLTTSWEACQGSDILIESPSAMAGIHIAEALVIPYFRAFTMPWTKTRAYPNPFFVPDQKKGGSYNYLTHVLFETVFWKGISSQVNKWREEELHLPRTNLYRLQQSRVPFLYNVSPCILPPAVDFPDWVKVTGYWFLNEGYGDYQPPSDLVGFMRKASEDKKKVIYVGFGSIVVKDAKSLTKAVVDAVVKADVRCILNKGWSDRLSKDKNEIEIELPKEIFNSGNIPHDWLFPRIDAAIHHGGSGTTGATVRAGCPSVIKPFFGDQFFYATQIEDLGVGLSLKKLTAKSLTKAIVSVTTDSAIIDKCKKLASKMSKEHGVLSAIEAIYSELEYSRNLSLIKDNHNINYKKHNPDFPARVGSPKSDSSGESVLTSDVKNSSFLSFAV

SEQ ID NO: 7688 - protein, 1419 aa, Rasamsonia emersonii
MPHPDDAGKSRLGFRLSTPSKSHRRMSSSRMPERLKDGDDAHEDVTAPPRDANGRDVHYMNQSIFSMIAAAGSKSDFHSRFDDSSDSDGGEAEKPEEESSRRPTSRSKPQKIEKPTLEVPDEDDKEEGEGSAEERGRGHRRRISDSKLMRSISKFHAKHSKGKESVDKSQPAARDKSVSPSPARLSGSMTPRSAPVLSRMIEAQSRYDPAASSTGTATSTEEGNGEKKSSESASTSLLATRLKEIFGFDRPEQVIGEYPCWLMQSALLQGYMYVTEGHLCFYAYLPQKSNTAVKTGYLAKRGRKNPKYSRYWFSLKGDVLSYYADPSKLYFPSGHVDLRYGISAALSDQKDKGNEVKDFTVTTDNRTYHFRADSAASAKEWVRALQKVIFRSHNEGGRVKISLPIENVIDIEENPMIDFAETFKIRVVDSGETYAIDEYFFSFFNYGKDAFNVLKNLINDTPAQRISQDPLATFGLKGSPESSRHRSRSADTHQRSSSSGPFVEAGAGDAGGVSVFNGRSAHSRTKSDSRSRRRSDVMSRASLAQSQQDRSLQEKQHDSSDSFVQSLGQGTESSVILQSTTDTAESASQILNRSDVFRSPTIHRLRSTPSASEDTARSGPRKVSVGDVAPPGYSLDELSSKRDQESQGAISESDHDAPSSSKVYATSTPTLQEIVRAGAYPLQRAAGFAEYIKSRSRQMSSLLASESMGYIEKVSGMWTGGGRHYAEGEGFHSERFLDQEDMEHSSSHGDRFRAHFALPSTEKLQATYYGYLHRVLPLYGKIYIGSTKFCFRSLLPGTRTKMILPIKEIENVEKEKGFRFGYQGLVVIIRGHEELFFEFNTSDARDDCAVTLHQSLEAVRFLVESSVLTQQENEEADAAKAEHQLLQEARQDILDEESQEVHPIFDDPRASIINFKPAESLRITCLTIGSRGDVQPYIALCKGLLAEGHRPKIATHAEFEPWVRKHGIDFAPVEGDPAELMRICVENGMFTYSFLKEASLKFRGWIDDLLSSAWKSCQDSDVLIESPSAMAGIHIAEALRIPYFRAFTMPWTRTRAYPHAFAVPEHRMGGAYNYITYVMFDNVFWKAISGQVNRWRKKELGLRGTNLDKMQPNKVPFLYNFSPSVVPPPLDYPDWIRVTGYWFLNEGADWTPPPELSEFIQRARQDGKKIVYIGFGSIVVSDPAALTKTVVESVQKADVRCILSKGWSDRLGDPTSTRPEITLPPEIHQIQAAPHDWLFTQIDAAAHHGGAGTTGASLRAGVPTIIKPFFGDQFFFGARVEDLGVGICMKKLNVSVFSRALWEATHSERMIVKARRLGEQIRKENGVANAIQAIYRDLEYATTLTRQRSAVSSTPFTPSGTDEKTVTEDDLEDIEETWTFVDDVTDPDLSKKGRGMDHENSGGQSQDRSQTRPADTSLA

SEQ ID NO: 7689 - protein, 599 aa, Uncinocarpus reesii
MLKTFWRVCELLAQQETDHGDDSGPEAYEHDDDETFPPEAAAAKLLDSGLDHGLETSQPSDPSAQEPAPFNFDDPYASIVNFKPSESLKITCLTIGSRGDVQPYIALCKGLLADGHRPKIATHREFESWVRQHGIDFAPVDGDPAELMRICVENGMFTYSFLREATQKFRGWIDDLLSSAWTSCQGSDILIESPSAMAGIHIAEALNIPYFRAFTMPWSRTRAYPHAFAAPDHYMGGAYNYMTYVMFDNIFWKAIAGQVNRWRKRQLSLRSTSLEKMQPNKVPFLYNFSPSVVPPPRDYGEWIRVTGYWFLDEGSDWTPPEELTAFIQKARTDRKKLVYIGFGSIVVSDPATLTMTVIESVLKADVRCILSKGWSDRLGDPASTKAEFPLPPEIYQITAAPHDWLFSQVDAVAHHGGAGTTGASLRAGVPTVIKPFFGDQFFFGSRVESLGVGITLKTLTVSLFSRALWEATNSERMIIKAKLLGEKIRQENGVAAAIQALYRDLEYAKTLVRRRVDAVVSNSAPLGSHEAIKNWEDDLVGIEDTWTLIGHPDTDMELSQSSKDLGSDFDLRASAAAATGTRPSALVEEGDEDGEDAGR

SEQ ID NO: 7690 - protein, 1331 aa, Serendipita vermifera
MSGTTIDTDASTLHLHEEEDNKEMSQSVVDRIIRKTSQVTKSGHRKLNSLSRRVKSPHEASAEQNGTHEETSGDTVDPFAQPTSNPPSRPSLNASFRGEGSLRMGTQTLIQALQAIPWSDVEEGPNDKDDSDENDADHKPAFTLSSSIHTIHRPVARIHKRSKAAAPIASSDDDSSIEEEEDDFDIQAPPLGVAAASPLHITTSTQPTKGPTSMSDSRTMMRRTTSLATVKVQKRAKLAEKLKAVFEIAEIEEVTAEMPCWLLRSVLLQGYMYLTNSHICFFAHMPSRENQILKSGSLAKKAQRTKRWNKHWFVLKNDALTWFHSSADPYFPHGVVDLRYAISCEPHGEKGIRVRTNQKTVNLEADSVPSRDEWVKSIRKVIFQAQNLGDNVKIAIPYSAVLELEKSKAMDFSETIEIKVLDKEDSCVDSYFFAYFHNLDLAVEEIRQAVQKGKSIPRSSAQETVKDTTSNLHAPPPPPVQQDSLSSTSQGTLSSVRDRLSAPVGKLGSMLRPVASAPTPPSGSRPTSMLSSDSGPMFTSPASTTPIQSKTPTDHTYPPALIHHPASGASDNSAKSTWSVPVGVPSWLKAPSRRFFFSSPDSTTTALAQGDIGDIHETSAHSTLDHADFGFSIVDGVDSNALDPMTVDKFRAAFAFDEKETLLAEIPGYLFRVLPVFGRVNISSNYFCFRSSQPLTKTRMMIPIRDILSTENAKAFRFGHHGLVVVIKGHEELFFEFNSTERRNACAELLAKLVEECRERQRFLGTSPHPVTRQDSLVLETLTETETEPNSPVQPPPESQSEALPAVMFTSLGSAFLTFKPQESLRFTCLTIGSRGDVQPYIALAKGLQADGHRVKIATHLEFKDWIEGHGIEFGYVGGDPAELIRICVENGTFTVAFLREGLSKFRDWLDDLLATSWDACQNTDVLIESPSAMGGIHIAEALQIPYFRAFTMPWTRTRAYPHAFAVPENKMGGSYNYLTYVMFDQVFWRAISGQINRWRKVTLGIPPTTMDKQEAHKVPFLYNFSPAVVPPPLDWYEWIRVTGYWFLDDSENSTAKKWEPPAELLKFIETARADNKKIVYIGFGSIVVSDPDAMTKCILEAVKKSGVRAIMSKGWSDRLSTKKADANVNDAHMPLPPEVHNIAAVPHDWLFSRIDAACHHGGAGTTGASLRAGIPTIIRPFFGDQFFWADRVEALGIGAGVRKLTVEGLTTALVNATTDTKQIARAAAIGKAIRAENGVATAVESIYRDLEYARSIIKFSQEHHDSDGTEGLVEAPHDDVRSNRALSDDWNLVDEGHLENGKDHGGILSPLKRVSLGLSGLTNNLHHPRH

SEQ ID NO: 7691 - protein, 1245 aa, Diaporthe ampelina
MDFPEQLQQKDGDEEQEEDVVPIGLGNGNHSFMNLNQSIFGLIAAAGPKVDFHDRFEGHSSEEEEADESDDDGARPKRKDDAATGKLAQTTVLKKPASKTSKQHRRKFSDSKLMKLQKIFEFEEPEELISGVLLQGYIYITSKHICFYAYLPKKAVSQPEPHPEKTSLTIYKHEVTKSGYLFKSGKRNPKYNRYWFRLKGDVLSYFRDPSNLYLPHGQIDLRYGISATITDKDKDGLHFSVETDHRTYHFRADSAPSAKEWVKCLQRVIFRSHNDGDSVKISLPIANVIDIEETQMLEFADTCKIRVIDNDETYAIDEYFFSFFSFGKEAIGVLKILIEDATSTVNDSQHRKLDVPPTVDEAAASTVPASKRSSSTGLQPGFQPGLAPIRTAKIRDNGVDLSSGEKMEGNPSTPTLQTISKMGSYPLQRVGAFAEYLGRHSKRVGGLLATESVGYAGKMSGMWKGGQRHYDEPAALRTDDEADDEEQDKVSEQRFQDHFALPRSEKLRATYFGYFMRVLPLYGKVYMSDRNFCFRSLIAGSRTKLILPIRDIENVTKSSGFRFGYAGLVVVIRGHEELFFEFGDSALRDDLAIFLLRGIEAAKFLRESGELDSEEKEDAQNAEEEHKALEEARHDEFPDHEITLPRQTSNISDGPTIIFDDPKASFINFKPEKALRITCLTIGSRGDVQPYIALCKGLLAEGHKPKIATHAEFKDWIEGHGIEFSPIEGDPGELMRLCIENGTFTVAFLREASSTMRNWLDGLLASSWLACKGSDVLIESPSAMGGIHIAEKLCIPYFRAFGMPWTRTRAYPHAFMMPERKMGGAYNLVTYVLFDSVFWKFTAHQINRWRNKTLGLPNTSLEKMQPNKVPFLYNFSQHVVPPPLDYSDWIRVTGYWFLNEGGENWTPPADLVAFIEKARKDDKKIVYVGFGSIIMDNPAKFTREIIDAVLKADVRCILSKGWSDRLDPKSEEAQKAGAADGDNSTKGTHGGKSGTTEIPLPPEIFPIKSAPHDWLFNQIDAAAHHGGSGTTGASLRAGIPTIVRPFFGDQFFFGNRVDDLGVGILLRKWGVNSFARALWEATHSERMIVKARVLGENIRKENGVDTAIQCIYRDMEYAKSLIERKAGRNAAAAERAATSGSDDLDDDVEEESWTFIGDDTGTDENDLDIDGVMRRSQFLVPIGLPEGPSARNKSLGSKALMSSSNPLVMPGGNSAVKPPAQRSPLSPPRQGSTSNDSAKENDRGR

SEQ ID NO: 7692 - protein, 1033 aa, Fusarium oxysporum
MIAFADTCKVRVIDNDETYAIDEYFFSFFSFGKDAINVLKILIEASAESRSAEKAVSSREENESSQSPSGRTSMAASRHLPQIDRLHTGKLPDAVKATLAPMSPLSPHSPSQLSPRASMDAPRSSFDGFRRFGRKSMDVPSSIGDFSSRRSFSGTRRSTSRHQHGSTTPKQQQAQDSGDSFIHSSIDNPSISTLSPSSFEDPSASQILQGSEVFHSPTMRRSASASRKRDQSGKKTPRNSTSNRERPRHIQHAATTGAMQEMGGETSDSQRPVTPTLNSITKIGAYPLQRANAFAEYLSRTSQRMGSMFATESLGYVEKVHGMWKGEHRHYDEPQELKTDDDVDDIDSDAEDKTQTAMDRFRAHFTLPESEKLVATYFGAIFKVLPLYGKFYISDRSFCFRSLYPGTRTKLILPLKDIENVHKEKGFRFGYYGLTVVIRGHEELFFEFRRPGLRDDCAVTLHQLMETNRFLEKSGFLDQEEQDDEEAAAAIAERDALKAARQDEFVNHELELPRETSGVSNAPTILFDNPNSSGLAFKPQKSMKITCLTIGSRGDVQPYIALCKGLLAEGHKPRIATHAEFQGWIESHGIEFARVEGDPGELMRLCIENGTFTWAFLREANSTFRGWLDELLDSAYTACEGSELLIESPSAMAGIHIAEKLGIPYFRAFTMPWTRTRAYPHAFIMPEHKMGGAYNYMTYVMFDNIFWKATAFQVNRWRRKTLGLPSTNLEKMQPNKVPFLYNFSPSVVAPPLDFSDWIRVTGYWFLNEGGDWEPPQELQDFIAKARADGKKLVYVGFGSIIVKDPAKMTQEVIDAVLKADVRCILSKGWSDRISPKDDPSKPRPEEPEMPPEIHVIKSAPHDWLFSQIDAAAHHGGSGTTGASLRAGIPTIIRPFFGDQFFFATRVEDLGVGVWVKKWGTNSFGRALWEVTRNERMIVKARVLGEQIRSESGVDSAIQCIYRDLEYAKSLIKRNAGKAAQHDANEDDDTEESWTFVGRDEPDPDAVTKKLSEGLVDTEKPLSLGSQAPSTAAA

SEQ ID NO: 7693 - protein, 569 aa, Citrus unshiu
MENHGRRCSDASEDVSVDYDAEIESENCNGRGDSSGGQNAARDDASTSSDVRSCSSSERGKVVHNHSLGILSARLFDERVPFRKKLKWLNRLATVKDDGTVQFEVPADIKPQNLDFGTGVVYTDDSTDQEPIEAADVHGIPRLHIVMLIVGTRGDVQPFVAIGKRLQEDGHRVRLATHANFKDFVLGAGLEFFPLDMVKNKGFLPSGPSEIPIQRNQLKEIIYSLLPACKDPDPDTMVPFKPDAIIANPPAYELLKVPLHIIFTMPWTPTSEFPHPLSRVKQPVAYRLSYQIVDALIWLGIRDMINDFRKKRLNLRRVTYLSGSYSSPLDVPYAYIWSPHLVPKPKDWGPKIDVVGFCFLDLASTYEPPDSLVKWLEYGEKPIYIGFGSLPVEEPEKMTEIIVKALEITGHRGIINKGWGVAESKDFVYLLDNCPHDWLFSRCLAVVHHGGAGTTAAGLKAACPTTIVPFFGDQPFWGERVHARGLGPAPIPVDEFSLDKLLDAIRFMLHPKVKEHAVELAKAMENEDGVTGAVKAFYKHFPGKKSESEPELPHSHRGLLSIRRCFGHT

SEQ ID NO: 7694 - protein, 1217 aa, Vanderwaltozyma polyspora
MIRNSTNTNNIMETEVALKDWILYYHKLCEVNSGEIFSGNEIITDFDDPVLSDPLLNLKPLPKNEVTVNKDNVIKDNDYSSNGCDFAKSKFHIKGLVGLLTTASVYIGLDNSTNPSYDISQACEFDLEDNTVQQGTGRSANMNPACKVAGFNKSSVRDTIFNIFKIPKKDEKISNDMEVNNTLSRDLDYKKDLFEFVRKYFGISEEETLIGHYTGWLLQEVLIQGNLFITNSSLVYLAHLPKLTDAVVLCGKLKLRSRLKGNPRYWCVLKHSTLALYNDPSDIYFPILSIDLNHVEEISLENSLKDENTMTFVLEASSKNYKFIAGSSHSAKTWVKCLKKQLFSIKNQSKDTIGIKFPISSIIDVECQSYMNQGQSIKVKCFDGNKNYALKEYTFLFFDKDGDSFYNIISNFIPRNMNPVEASLQNSNPTIHLNSKSHFNDKIKILSAVNIDDIICDTDSFEMTSSDILSDIDENIQPLSLKHVRDISNCKNYLKEDLKTSNKMTIQDCNKKVQTSEIQLITYSKHDSRMELNDDSKYYQGNIGNDNKGILSFKNICSIWNTSPIHNKDSDNFFMTSDPFVTSINDTTLAKIKDWFNLHDNEVLHALYYAYLIKGYPVYGKLYVTNRRLYFKSCIPGVNVKMVLPLEDIEGYNEILGTNYGNFGILLTVQNEKELQFGFNSCTNRSDFENVLQRCLDICKYAIKTPELVTSRVIESESEHSRLRFFEEKFSTEGIDIPFLVEDNPYFKTKIMPTKSYNFGFLTIGSRGDVQPYIALAKGLIQEGHSVTIITHREFKSFVECHGIDFKEIAGDPTKLMSLMVEHEAINVGMLMEASSKFRGWIHDLLVTTWEACKNLKLDILIESPSAMAGIHISEALQIPYFRAFTMPWTRTRAYPHAFIVPDQKRGGSFNYLTHVIFENVFWRGICSQVNKWRVQTLGLEKTNLAQLQQNKIPFLYNISPVIFPPAIDFDEWIKVTGYWFLDESESFEPSQELETFISKARKLGKKLVYIGFGSIVVNNAKEMTRAVIDSVLETDIFCILNKGWSERLGKEELRYEEEPEYPETIFLCDSIPHDWLFPKVDAAVHHGGSGTTGATLKAGTPVVIKPFFGDQFFFASRIEDIGAGIALKKLNVSSLSNAIKKVLTDKSIKRKAVSLKKRVAKENGVTTAINCIYSELEYARSLVVKKNHKSSNIEFIQHPNNVNDTTKTVIPLTSMV

SEQ ID NO: 7695 - protein, 1378 aa, Penicillium brasilianum
MRPFLDDAKRQPERADQRLSASMRPSSGQRLLSDRMPERFRDGDDAQVDYTAPPQNMRSRDGHMHYMQQSLFSVLAAVGSRSDFRGRFDDSSDSDGEAGESHTKTGLQSGSSREGSSDRRRTSKKTTTNSRDEAEERGRRHQRTKSENKILRSIPGVGSQDKPDEPLAASGATLKVPTRRTRSATPRAAPILTRMIQAQNRFDGATEPENPPSRPESPSHDPLEPSESSALSTRLMEMFGFERPEKVLVEYACALLRSMLLQGYMYVTEGHICFYAYLPKKSTTAIKSGFLAKRGRKNPKYNRYWFVLKGDVLSYYADPSNLYFPSGHVDLRYGISASLAETKAQGSDAKDFQVTTDQRTYHFRADSAASAKEWVKSLQQIIFRSHNEGDSVKIAFPVESVIDLEESPMAEFAETFKIRVLDNNETYAIDEYFFTFFNSGQDAFNYLKSLVHSSPAKNLSDDSPHKSDDKVQYEICSRDSNIMAANSRRLSLPTDDQSPHGRSTSIENDPQDSADSFAPSIDRGTESSRIVQSLTETNESASQILNRSDVFQSPTMRSLPRRPSDVGATGRRRSDDTARSASARLGGIVRRDSSGLSSPSRNAEDSRVARGPADQRISNPSRYPPGAPLNDLVKAGVYPLQRAAGFAEYLKSRSKQMSSLLATESMGYIEKVSGMWAGGQKHYGETEEVIHDDPTVDPEDKQGGLKHGDRFRAHFGLPPTEHLQATYYAYLTRVLPLYGKIYLSERKICFRSLLPGTRTKMILPLKDVENVEKEKGFRFGYHGLVVIVRGHEELFFEFNTADARDDCAVTLHQNLESVKYLVESGMLAEEERDRVEAAKAEHRMLEEARLDSPVEHDTHPTLNESSSEISPFFDDPRASIINFKPTESLKITCLTIGSRGDVQPYIALCKGLLAEGHKPKIATHAEFEPWIRSHGIDFALVDGDPAELMRICVENGMFTYSFLREATSKFRGWIDDLLSSSWTSCQGSDVLIESPSAMAGIHIAEALRIPYFRGFTMPWSRTRAYPHAFAVPETRMGGAYNYITYVMFDNIFWKAIAGQVNRWRANELGLKATTLDRMQQNKVPFLYNYSPSVVPPPLDYPDWIRITGYWFLNEGSDWTPPAELSAFIERARADGKKLVYIGFGSIVVSDPAALTRTVIESVRKADVRCILSKGWSDRLGDPSSQKLEIPLPPEIHQIQSAPHDWLFSQIDAAAHHGGAGTTGASLRAGVPTIIKPFFGDQFFFGSRVEDLGVGICMKKLNVSVFSRALWETTHSERMIVKARNLGTQIRNEDGVATAIQSLYRDMEYAKTLARQRSIASSTPFSPTPSAQASPDHDDDDVDDIEEWTFVGDENEMDLTKRMRDLSASDREKVASAVF

SEQ ID NO: 7696 - protein, 1482 aa, Coniophora puteana
MSKLTSWKPLARGPVVTGPHDTSPQGMGLEDKGSDTEDNDGALSSSAQRFKRAVLKTVDLGKSVPARARSPSSPFKGTKGLLSMSGQGRTRPSANPADSSKASPSDGPSNLKVSTSSLGDDSPFIKPPSPTHTPLRPLLQSFRGVGSMRAGTQTLIQALQALPWAEDPDNETDPMSAQLGQVDSDGDDDVAHDPETPMSSSIHAIYRPVARFRRSEIKLPSASQTQGKLPVQPREESETEEGAGPSEDDAENDFEAATPRPEEAQRPAYIMSQSAASVKHLNYSRRVNVSCTGSMATVKLHRRARLAEKLREVFELDSIHEVLTEMPCWLLRSVLLQGYMYLTNSHICFFAHMPTREDQVLKSGALFKKATRTKRWSKHWFLLKNDALSWYQSSSDPYFVNGIIDLRYTLSCEPVGEKEIRIRTNEKSIHLAADSIPSRDEWVKAIKRVIFKAQNMGDTVKIAIPYTAVVDADKSSAMDFSETIEVKVIDKEEPYAVDSYFFAYFSDLSLALDQIRDAIRSYRTLSSVEHALLDTTSNRPTPVSPAIDRARSLPANDSKNSTGFRLASLLRPFHESLPSGKQNSVLEATPNEGTDEFTHITKREGSSFVPIETGGDGSLEPVRSVASISQTNASSRSGPTPTTHTYPPSTSMAELPLPLSRSTSNAAWNMGIPSWLKAPRKALVSSSSSTTIGPPDITTSPTSEVREMFSSTTQSEASQHDLGYSILEVPERVVDHNLTEKFRSSFAFDEKETLLGYFYGYIYRLLPLYGRLYVSTNYFCFKSSGPLSTKTRMILPIRDILAVETSKASRFGHHGLVVVIKGHEELFFEFGFEDRRTAFVTILQQQIEELRQRLTGPDLPNISQGHRDALVLEEFESKPSTNSEVCTEPSETLSESVPAVMFASTSSTFLTFKPKESLHFTFLTIGSRGDVQPYISLAKGLMQDGHRVRIATHGEFQDWIESHGIEFGFVGGDPAELMRICVENGTFTVAFLKEGLLKFRGWLDDLLRTSWEACQGTDVLVESPSAMGGIHIAEALQIPYFRAFTMTWTRTRAYPHAFAVPDRKMGGSYNYMTYVMFDQVFWRAISGQVNRWRRNVLHLPNTSLDRLEPHKVPFLYNFSPTLVPPPLDWPEWIHVTGNWFLDDADVSATKWTPPPDLLPFIDSAHAQGKKVVYIGFGSIVVSDPQAMTRCVIEAVVRSGVYAILSKGWSDRLHTKTAEASEPKEPLPPQIYSISSIPHDWLFQRIDAVCHHGGAGTTGASLRAGKPTIIRPFFGDQFFWADRVEALGIGTGVRKLTVEALTDALTSATTDIKQIDRARIIGEQIRSENGVATAIEAIYRDLDYARSLIKRTADRTLDDEPNVESPDQEQFPQPSQSLMDRSLSRSHRSSRGSHRKTPSEDWSVISDQEEPRSSPSSRRNSRRSSEGKIERSPTAKRTGLTAAVMSVLPSATHRRSGSIHLNRPRIDISIQPTNFCYDLYALA

SEQ ID NO: 7697 - protein, 1258 aa, Baudoinia panamericana
MSQSQFLPPRETVVEPPERPTSADGVRSDAPMLDRKLQAKARAEMDASTTSSSSRKGGKGAPAQVAPNKPELANALADIFQFDEPEEVIGEFACWYLQSVLLQGYMYITRKHVCFYAYLQKKGHIVIKSGHLAKQGKRNPHYRRYWLVLKGDVLSYYESAADPYFPRGTIDLRSAVSAELTPEKGKATKETNVFAITTEQRTYHFKADSITSAKEWVKQLQRVIFRSRNDGDSVKISLPLANVVEVESSPVTDLAETVRIRVIDDGTTFAVDEYFFTFFSRGSQALDVLRTLTEDNEARRRASRHGRALGPEQSPRDSDRSPGVPQPVRSTLSPVSAVAGRLSPRASGEYRRSSGETSRASIDQGRASFDRGRRTSVQQGRRSSKSPVSPSAHNSADSFKTSSEHVSSAPSTPGGVNDMSASQMLTGDGAFRAPTLRQPLPKSTLSVTTVERLRREPQQLSAAPMQTAPGTTRRQPPSRTLAGEIMAVTDPPRPMHTILATPLQFAYGLAEQVRDQSRRGLSYLGSSPKDYYNRFSGALAGGKLEYGDDDGRAAEDRIRDSEANLDEANAEKRFREHFKLPESERLLTAYYCSLHRVLPLYGKIYVGTRHFCFRSLLYGTRTRLVIPFSNLLNLEKEKGYRLGYPGMVVVIRGHEELFFDFQNVELRDDCVVNVLQRLDTARQLQDSLLLTEAEKMDAAAAAAEHEVLQRARKDGFANENFVLPQDLQNVDLSDIPDAPILFDDASMSILDFKPKKPMRITCLTIGSRGDVQPYIALCKGFMADGHHMRIATHSKFKAWIEKHGIEFAPVAGDPVELMELCTEHGMFTPSFVFESLGKMRPWLDELLKTAFTACKGSDLLIESPQAMAGIHIAEALGIPYFRAFTMPWTRTRAYPHAFAVPSRKLGGQYNYLTYTLFDNVFWQMSAAPINKWRGKTLGLKPTTLDKLQQNKVPFLYNYSPHVVPPPLDYSDWVRPTGFWFLDEGANWRPPDDLMRFITKARADGKKIVYIGFGSVPINESKQLLQQVVNAVIKADVRCILSKGWADQGSKKDKTTALPIPLPDSVFEIVAAPHDWLFKQIDAAVHHGGSGTTGASLRAGLPTIIKPWFGDQFFFATRVEDLGVGFYLRKTTSNELGIALWYATHDERIIKKAKVLGEQIRSEDGVGTAIKAIYRDMEYARTLIKKRAVNIKATDVDDAEDEEEESWTFVENESDVDIASLRLGDSAATGSTAHQQWNRALQYGRHLSLGATALKGRLT

SEQ ID NO: 7698 - protein, 1656 aa, Candida auris
MSKKSSASRERKMLAKLGIEEKHEYLQNYLPLYRKISDAVIPPLQSSLEFIHGGTHDDSSDHSDAQSRYMDADDGKTRNGHNGERQNIEPHEDDSYDVAMPLGEEHASNSFLNTLTMANVYAGVGSLKNLKNLLSDLSNPSWLDHKGGRLVGYSMYSSESEDEDEADHDGSSGKNDDTERDDKYALSDKPSPTKKTAQKPAPTSTTMASSTTEASTATEASSTTKSSYTTKASSTTSAAKADPTDVDEEEDAAGCAQPSTTVPLVLDETITLQDSTAESFKPTLEPEPPIDATVGTGFLYDAFELPPESDWTPWQHSVMKRLDITPLKEVVLIKFKEQSPSKTDVESNIRQKLTWIIGDRMRKTFELKSSDTFYANFDSWLLRDVLLQGQIILSEDAVCFYSLLPGTMDHQSDQQENPDLALYEGTLGMKVGEGLLLSNTHRFWAVLRPETLSFYTSSTDMYFPEKVVDLRNALYCELSKDPAQPSSPPPGSAEGVASPKSRGSFSRDSFYLSTASISPSQPGSETSSINEADLEEASEEMSTGVWFKVVCTNKTYRFQAGSLFSARHWYNSITKAIFQLHNCNVRREVLHKIPFTQIVEYQKNFVLADAMTGADNSEDNETPISFSIKYVSPHEPANLKFKGKFEVGKQGPYETVHFVMFHMGKDFADTFGNLYDKNKSQRHESQRTLNQRVKRRAKMVFNDDVPSSSQNMPSLTTLQPDYASANSLVDKIAKVNDRIIQNKLNEASSSGNFSDDEISTSEGNERIRSMAKLLGINKLPKIECESSGSLSPKSIRAAWESRQSISDAITSPLQEDGVFLQLPKPFSLSTLKNLNLNMILSKRSFADIEKRLIAMDESNPLERSNTMTNVTFTESYKEFAESISELTISDGDKKSKHEAPKKSKFDTLKKKVKTVSGMGGVWSANPDHYIKLDDVEDDKYYVKNASERENNEKRFRKHFSLNSDSKLVATYHCHLKRSIPVYGKLYLGSDKLCFRSLIPGISTKMILPLKDIENCANEGGTNFKYSGLIVTVSGMESLILEFGSQKSRNDCSTMILQQLEIIHADESWAPKAHEWGVAAKYRDPSQKEDMIMRSNHQSRERDIALAKAKIRIARLRHLEDRISTASGIEFPLIFEDSLFYQTEVRPAKSYNITLLTIGSRGDVQPYIALGKGLLNEGHSVTIATHSEFKDWIEKHNLIFKEIAGNPAELMSLMVTHGSMSVGFIKEASSKFRSWITELLDTSWTACQGADILIESPSAMGGLHIAEALGIAYMRAFTMPWTRTRAYPHAFIVPDSKRGGSYNLLTHVMFENVFWKGISSQVNKWRVEKLGLSKTNLSKMQQYKVPFLYNISPSIFPPSVDFPEWVKVTGYWFLDEGDANYEPRKELVEFINSATQNNEKIVYIGFGSIVVSDAKSLTKAVVEAVEESGVKCILNKGWSDRLSKDKGEIEIELPPSIYDCGPVPHDWLFPKVDAAVHHGGSGTTGATLRSGTPTIIKPFFGDQFFYASRIEDLGVGIALKNLNSKSLTKALKSITRETKYMEKAKAVAHSMEHETGVLTAIDAIYSELAYSRSLMLTVRYNTEARRDDRSGIQTPVVDEEDYFMEDDDSDDDISDDEDDSEMSDQSEDECSESESKINKKKTKLCPLSSNRQNEKST

SEQ ID NO: 7699 - protein, 841 aa, Rhizoctonia solani
MIIPDDTDDKSKSAPAEHDTRHIQIDSESGSKPPPSTGYEYDHEEPGPPQYEEATRGTSAPPSSVDLKSAKDPRRESTQSYASTSSSIPEGEPNAEFRTAAMAASAAFQPDGRFQVSIDESPEKLPRNYGSPIDEPAVDLTNFANAPPMNVNIMIVGSRGDVQPYLALGKRLRQHGHTVRLTTHETFRQSVKEAGLRFFNIGGNPHELMSYMVRNPGLMPGFESLTNGDITRKQMMVAEMLERCWRSCYEPDDALDGGANFVADAIISNPPTFAHVHCAEALGIPLVMSFTMPWSPTTVFPHPLVNVRKSQAEPRMTNYLTYGLADAMTWQGLGHTINKFRRKRLGLPSLSVVSGSGIIERCGVPWTYCMSPALVPKPQDWVNHIDVVGFYFLDLATEYTPPEDLVAFLDAGEPPIYIGFGSIVVQDPIEMTKTILSAIAQTHVRAVVSAGWGSLDRKTLGDALDSNIFILGNVPHDWLFERVSAVVHHGGAGTAAIGLRCGKPTVVVPFFGDQPWWADQIHARKAGPAPIPHKQLTASALAGAIKSALSEETRAAARKVGELIRSEDGVRNGMDSFHRHLPLLNMRCDLDPRRVAVWYSRSHKLRLSAFAAQVLAERGVLDVNKLELHRPREYITRVQPTNPVSGTLAPTLGVVGDVIGGVGGLFTTRPEKGVIKLVKAGPEAARGILEGLHHGMNNAPKIYGGSVREPGKVTGFRSGLREGRKSAAMGFYDGFTDIVKEPVDGFKKGGIMGGVGGVLIGLTNAVVKPTAGIVGMLSQPVEGTIQSARSFMAKPVKERYATRYAEGVAAFKESTEPEREAVIRAFEEKSRSKIKGKQKST

SEQ ID NO: 7700 - protein, 1370 aa, Penicillium griseofulvum
MRPLRDDAKRRADRQMSASMKPTWSNRPFSDRVPDRFKDGDDAHVDFTAPPQGMGSRDGNVHYMQQSLFSMIAAVGSKSDFHTRFEESSDSDGDMEEHPRMEQTIGKTSQAPMPSFDYRHPSKRSEPNTLVQEERGRRHQRARSDNKLLQRVSTLDLQGGANESSNQIDSTVKAPSLRRTRSATPRAAPVLSRMVEAQSHFDLTSITPHLPSNPDKPMEDQQQSSASALSTRLMKMFDFAKPEKVLVEYACSLLQSMLLQGYMYVTEGHICFYAYLPKKSNVAIKSGYLSKRGRKNPTYNRYWFALKGDVLSYYADPSNLYFPSGHVDLRYGISASLTERKDGDTKDFQVTTDQRTYLFRADSATSAKEWVKALQKVIFRTHNEGDSVKVSFPIANVIDLEESPMADFAETFKIRVLDSGETYAIDEYFFSFFDSGKDAFNYIKGLVNAASETTPMKDPQVQHDIKHQPESSHTAYKRQSVSCVRVSDHGEEGSPRKRSSSVGNENQGSADSFAEQGTGSSPIIQSMTDTTESASQILNRSDVFQSPTMHTLQRRPLDAGETVRRLSDDTTPSASVQLDLGAMADSPSATLGRKEVTEATRYPTGQPNPMESSRPSSVTHLNELVKAGAYPLQRAAGFAEYLKSRSKQMSTLLATESMGYIEKVSGMWIGGQKHYGEREGPLQDQNVDPEDNEGAFNYGDRFRAHFALPSTEKLQATYYAYLHRVLPLYGKIYISQKKLCFRSLIPGTRTKMILPFKDIENIEKEKGFRFGYHGLVVIIRGHEELFFEFNASDSRDDCAVTLHQNLESAKFLVESGLLADEERDEVEAAKAEHRMLQEARLDGPEEHDELPTSTEDSSEIHPFFDDPRASIINFKPPEPLRITCLTIGSRGDVQPYIALCKGLLAEGHKPKIATHAEFEPWIRKHGIDFAPVDGDPAELMRICVENGMFTYSFLREASLKFRGWIDDLLSSAWIGCQGSDLLIESPSAMAGVHIAEALRIPYFRGFTMPWTRTRAYPHAFAVPENRMGGAYNYITYVMFDNIFWKAIAGQVNRWRNNELGLKATTLDKMQQNKVPFLYNYSPSVVAPPLDYPDWIRITGYWFLNEGTDWTPPIELSNFIAQARADGKKLVYIGFGSIVVSDPSALTRTVIESVQKADVRCILSKGWSDRLGDPASTKTEIPLPPEILQIQSAPHDWLFSQIDAAAHHGGAGTTGASLRAGLPTIVKPFFGDQFFFGSRVEDLGVGICMKKLNVSVFSRALWEATHSERMIVKARNLGIQIRNEDGVATAIQALYRDLEYAKTLARQKSLASSTPFSPTPTAKTSPDGGDDELDDIEEWTFVGEETGFDISKRVRDRAASDADKLGTNMFQ

SEQ ID NO: 7701 - protein, 1750 aa, Moesziomyces aphidis
MGSTVDSALSGCGRWKRAGKEVRERGCRWAFLRASASLFKNLKNGHAGTICHERGMPHRQQQKLENRRFQKSPVPWQREGSGVKGSHTGALTLADCGSGGWDGGGRVPQKRPTARSTVLAVRELNTTALILCTSVACLGTAFASSLAGNHLQPPASQDVILASTASVLIASASASIAAKVPEGPLRAIIMSFEATQGPVPTSGDEPRSASMPTSQGAADEAHTSTSDNASEVPQQSVDLSDSFGTPPFPKSPRLDPSSPRNFSTISSLAGSRELGRPVLEPTTRIFAVGPTASTPPAKVSLPPMRPPGISQGQPADVAFHAEPQGLMQMLSLVGSTLLEAERVGFAEDDADELEAQPSARTADPSDPFGIPHDVTGSASRRSTRHFAPGLARSVFDLASAGTAKGRLRALAREDASDDGSTPQGSRSPLDGSVHTIGASRKKRISLTQSEIFASPSDPTADSSGRRASSLRSQLQPSPFASGSTSTLNCELDSDAPDSLDQRSAGQTAAGTLPIEKRSISMQHQLSFSPINSIAQLPTEGDVDPLLIRPYSHSLVADTPVSDSALDHDRLEQQLRDTFQLDASETLVMAQPCWLFRSLLLQGHLYLTNGHLCFYAYLPSRDEKVVKTGVLGKRTRRTHRFSKHWASLQGSKLSWFDSDRDPYFPQGHIDLRKVSAIEPSQNHKDRFKLNTPARKFTFLAEDEASRDAWVSALQKETFRAQNQGESVRISIPLETIMNHETTLSVDGTEMVCISVVDEAGDFSVDEYYFLHLGKPSAFIAALNGLIDSGLGSVSSLQSGDAALNLSKLSIRDSTGAAYAIAMSRRSLEEVPTLPKVPVKAQAPDTTAPADRTETLVTSNAPTMAAVAIPQSGRRKSQDGSADGVFSTTPRAAALNRLSMESTHTYPPSPSLSDPPTSFDQVQREAERSWSIPGWLKSAPAKVLGRTHSSHPHASNAQDSERTSGSKRRRKVLETWSGDNTESISREGSSTDTEDDMLSHSIHSTQSGFSMLDADDEGQEDLGRVAAEFRDTFGVVQDEGLVGHTHAYLYRVLPVAGRFFVSERHLAFRSSGIAAKTVGRTLMLVPLQDVISAAKQLAFRPGHHGMVINISGHEELFIEISSANRRDELLSLIEYQLELISAGHRSKESRDTVNREQSHALVLRDLSEKITDDPSTTSVASSADSSMLSQQSSDLDTSGDLSHLGGRASLLTFAPTAPLTFTMLTIGSRGDPYIALAKGLQADGHNVRIATHAEFGDWIMGHGIGFSEIGGDPAELMRICVENGTFTVSFLREGVTRFRDWLDDLLASAWRACQGSDVIIECPSAIAGIHVAEALQVPYFRAFTMPWTRTRAYPHAFAVPNNKAGGNYNYMSYVIFDQMFWRASSFQINRWRKALLGLKPTNFDRLEQHKVPFIYNFSPSLVPRPLDWYEWIHVTGFWFLDNPDNSSSKKWEPPEELVTFIRRSRERKRKLVYIGWGSIVVPDAEAMTRCVLQAVRKSGVCAILSKGWSDRLSGDASKRSAALDPAVAEDVFQVSSVPHDWLFPQIDAACHHGGAGTLGASLRAGLPTVVKPYFGDQFFWGQQIESLGVGSCFFWGQQIESLGVGSCVRQLTADNLAAALITATTNAKQIERARKLGEQIRAEDGIGNAVKAIYRDLDYARSRVKRDTRIESDAPAAPRAENTQPTELRAGQLGARPELARTASQGFDDSHSSDGWSDIGGAPLSPSPPNADADAILDLSRAGPACVEAPLS

SEQ ID NO: 7702 - protein, 1623 aa, Trichosporon asahii
MSEQDREVVVETVTVETAPPELQPQPQSQLLGGVTQPPPPSTATDAPAIGPSRGLESAATPMPQQPPSSDLDQQTPTTDLPQHPAATNIPVASSESTSTLSTETQSTIPASASSASAIASAAAPMTDSSQSLPISQLQRLSISETTAEGLVESPADMSPLAAARPPFERTETGSTTESRKHTALPPVQTEGLLSPISAGPSLLSSTYSLRKGTGDSGRNLRGARHWSRDDVPPHSPEEGLGKESMVIQCDDDESDEDVCHGTMRMGTSALVSALTALPWESDEETSADEDHMSRTQVINPQRPRHEAHGGHDSHDGHDEHRQDHEHHLFHHHSRSRSRASSSGASSDSSMQSGSRTKSRSRSRSTSPHKRHHLFHRSLDFPFKENTIARRAQAPGPLELSYQLSPERPGHKPLPLSGATTPAEEESPKTRMDHEVDLGERIRKGKLAQRLQEVFGLEEEEEVVEELACWLLRNSLLKGYMFLTAQRICFFAHLPEQDPIKSGPLWKKSKKTKLSTKFWFVLRNDVLSWYESATDPYFPKGNVSLQYASSVDMISGAKFKLRTAERNYTFTADTEANAKEWVRVLRKVILKTQHHGESVKLIIPLDAVVEIERSPTLEFAETVEVKVVDPEDAMSVDSYFFAGFSDNDYAFDVIQALLSARPRKELDPPQVPSTAELQQQAQQLADEQGTRPGSAASYASASVSKVGSLLRPLISSQHTSDSRVPIAAPPPPSLPEVGDTSGFTSDYESEADSANRSHGGYPPKPVGRPPPRMLEQQSGSWGTPGWIRKPAAKLFGSSPSSSDIQPRRRPSRRVKKRKQPSVTEVVEPTIPLTTDEEMSETETPRRSRHRRMHSGGSSIIQRLTGGSVSDWSIDSETDEASRKFHAIFSMPDTEVLIDDFTGYLYRVVPVHGRFYISQNFFCFISTRAVMKTKMVVPIKDLYGLKGQKAFRFGHHALILIVKGYEEIFLEFSSKRTRDECSRLLDQRMEQVTLAEAAESDSISDPAKRGSTLTESPKFIEEHLASGKDEKVPSPMFGSSTSSTFLDFKPKPMKITCLTIGSRGDVQPYIALCKGLMAEGHECTIATHGEYKDWVEGHKIGFKSVGGDPAELMQLCVDNGLFTVAFLKEGLAKMRTWLDDLLVSSWKACQGADLLIESPSAMAGIHIAEALQIPYYRAFTMTWTRTRAYPQAFAVPEYKRGGAYNYMTYVMFDQVFWHAISRQVNRWRKKWLHLESTNLTTMEQDKVPFLYNFSPTIVPPPLDWSEWIHVCGYWFLDDASSKDKVWQPPKGITDFIDGAHAKGKKVVYIGFGSIVVSDPKEMTKCVVDAIVESGVHAILSKGWSDRGSRNSGDKSKIGDADGADGIKYPDCIYAIDSIDHSWLFPRIDAAVHHGGAGTTGASLRAGLPTIIKPFFGDQFFWAERVESLGVGDGIKKLTTDALSKAMKSATTNERQIAKARAIGAAIRSEDGIGKAIQSLYRDLDYARSIIKPLPHHRQPLPLRPRTGSTSDTATEESWSVVSEQSAMHSPGRDGAAGAAPVSASGTPRPDQVETLSEPRVRGGPLESLQKSLAHISPRHRTPTSASATSSSEASSHHHHHRLSGFVDHLLHHHHHHEKEDKAEKE

SEQ ID NO: 7703 - protein, 424 aa, Sorangium cellulosum
MKTTILALGTRGDVQPTIALGKALAARGHAVSVLAGKSFQPWIEAHGLTAVPGSVDMVEVMESDLGREWVSRGTNPMAQSRILQRLIDRFGAEMTDDALRACEGAELILSSFTSDTYAASIAEASGAVQVSIPFQPSILATRHGPTAVAAPFPRSDSLLNLLFGKLLIEPTVWRWYGGVTARVRQRLGLPPQDRRAYMAALRRMLVVHAYSAHVVPHPPDWPPSYHTTGYWFLDEGGDYRPPEALERFLAAGEPPVALGFGSMTSHDPGATTRLLVDAVARSGQRAILLSGWAGLGDTALPDTILRIDGAPHDWLYPRVAAAVIHGGAGTVAACLRAGRPAVVVPHLGDQLFWGRRVEELGVGPRAIPRPRLTADALAAAIRTAATDAGMKQRAEELGRKIRGEDGVAAAIGHIERHLAARATT

SEQ ID NO: 7704 - protein, 1203 aa, Saccharomyces kudriavzevii
MPITQVISASNGEAGSKPSISLVPDKASKQETPLKHHRLSRSLSKLKHWRGRSSSGSSIDSAEQHDLQGRLSEAYDNDADNGYNNDNADDLAKSKYMMKSIAGLLTTASVYAGMNNAQEMNALAQIDSEESESNESSQVKLGKNEVKSKKENLKSEVSPEVPSGSDKRKPTLFDFSVTREKLSKDNVTKLRQRFCLDEQEPFLNDFPAWLLKDVLVQGHIFITMKHFLFFAYLPKNPRSVKMSGNLNIRTKLIRSTRYWCVLKNHLFSMYTSSTELYFPVLTIDLREVQKIETQKNTLNGNTVKTFKLSTNENIFKFSADSDFSAKSWVNALKKEQFAAQNSENNSISLKIPLPNIIEIDDQPIVNKALTLRLRALESSHTYAIDDFMFVFMDGSGSQIKDSLCQQLTTLQKSGVNTLYNDSPSKNVKSIDEKEAPAPAEDQKVEKDENKDSRYLNVPNSAVPSSENGKKSRFRFRGRSNSWFRRAKLLEDSQIEDVEEIYKDATDDIDSSVHSTIQVHEQEDNQEQIMDWKPSHLKNFAEMWAAKPIHYRNECIEFEKNDTYLIKVAEEVSANERFRYHFKFNKDKTLISTYYTYLNRNVPVYGKIYVSHDTICFRSLLPGSNTHMILPLVDVETCYKEQGFRFGYFVLVVVIHGHEELFFEFSTEVARDDIECIILKLLDSIYASSGEGSNLSSTSIGDVQHNPDSAKLKLFEDKINAEGFEVPLMIDENPHYKTSITPNKSYKFGLLTIGSRGDVQPYIALGKGLIKEGHQVVIITHSEFRGFVESHGIQFEEIAGNPVELMSLMVENESMNVKMLREASSKFRGWIDALLQTSWEVCNRRKFDILIESPSAMVGIHITEALQIPYFRAFTMPWTRTRAYPHAFIVPDQKRGGNYNYLTHVLFENVFWKGISGQVNKWRVETLGLGKTNLFLLQQNNVPFLYNVSPTIFPPSIDFSEWVRVTGYWFLDDKNTFTPSPEIENFILEARSKKKKLVYIGFGSIVVSNAKEMTEALIEAVVEADVYCILNKGWSERLDDKTAKKVEVDLPNNILNTGSVPHDWLFPQVDAAVHHGGSGTTGASLRAGLPTIIKPFFGDQFFYAGRVEDIGVGIALKKLNSQTLADALKVVTTNKIMKDRAGLIKKKISKEDGIKTAISAIYNELEYARSITLSKVKSSRKNEEIVDPIKLPSAETTDEAWTMI

SEQ ID NO: 7705 - protein, 1461 aa, Bipolaris sorokiniana
MASQDRDRDRSTRRMSRRRRDSRRESRGMSLDVPERFKDGDDAQEDVTAPKRNNTMSMNQSLFSMIARAGQQSQTDLGTMQEADSGDSEDEGKRQASYHGLDGAARLSRLSSANDFDISTEEPHDKNMAKGKHRRILSENKLLRSLPKLKVSSRNEGRLEGPRAHPMSSSQFLPPKPSLSQSSAVLKKWQPKSKDKDMEKEKIDITMSEETQTERAFNTGRKSRNGSMAGLDKSQQPVTLAKRIQQIFEFEQVEEVISEYPCWLLQSILLQGYMYITQKHICFYAYLPKKHHDVTKTGYLFKRGRSKLNRYWFVLRGDVLAYYTNPAELYFPRNRINLQYALTAEVLESTKKGEEETSFAITTDERRYIFKADSAASAKEWTRSIQKVIFRTHNDGNSVKISLPIQNVLEIEESSILDLANTVKVRVIDNDETFAIDEYFFSFFNNGQDALNVLRIMINDNEHHQATPDASELENQTPSHRGSVTCPTDVIEMPQIRENVRATLSPLPVTHVRRSSISDVSGRSSNEVNRKSWDVRRSMDVSHALRRSSYETRQSPHEPRQSFSGDLHSTQRKHHSEDNSSQSPRAADSESATLSFEPGTESSAAIQSIDESNASASQILDRSDLFRGPTNLPVDNAPLSKLDLQHRDSQETTRSAQAKTTNVAKRSKQSAAVMGTPDFEDDTDASQANPRMSGSSSALQDIASYPLQKASGLAGFLRTRSKKMGNLLASESMGYYEKVSGMLAGGRKHYNTAEGLETGDQIHGFEDDEDAAKAVENFRDHFAFPETEILQSSFFASLQRVLPNYGKIYISGRYFCFRSLMPTSKTKVILPMRDIENVNKEKGFRIGYHGLAVVIKGHEELFFEFSKAEYRDECAITVLRILENTKYLEDEDSSSSGVDSGDEAAKAEHDLLQQAREHTDTRKQTDVSDIVRAADHDRIPLIFDDPLASFVDFKPSEPLKIVCLTIGSRGDVQPYIALCKELLKEGHKPRIATHAEFEPWVRKHGIDFAVVDGNPAELMRICVEHGMFTYGFMKEANSKFRGWLDDVCSSSWRACQGADVLIESPSTMAGIHIAEALEIPYFRAFTMPWTRTRAYPHAFSVLEKKMGGGYNSLTYITFDTIFWTAISGQINKWRRRELGLQGTTQHKMQASHRPFLYNFSPHVVPPPLDWPDWVRVTGYWFLDESDSYDPPAELLAFMEKARVDGKKLVYVGFGSIVIDDPAALTRTVVDSVLKADVRCVLSKGWSDRLETKDASKPEIPLPPEIFQIQAAPHDWLFKQMDAAVHHGGSGTTGASLRAGIPTIIKPFFGDQFFFAQRVEDMGVGVWLKKVNTSVFSRALWEVTNSQRMIMKAKVLGQKIRKDNGTQVAIQTIYRELDRARTLIKKQTKQDDDNSEEFEEDWTIIEEGEEMDGAHPFAMQQPLAGINQDASQMGAGSLVLGSMVLKGAVAKKQAPPEVARRD

SEQ ID NO: 7706 - protein, 1505 aa, Microbotryum lychnidis-
MSADNSPFSKAFASLSVASPTPALDLGDNTTSASDAPTPQGSTKTETGSKRSDSAAPSDERLAASSPGLSGRDRGPGRFGGMAQMGFRSDDDEETSPTFASHRARSQSVFESRSRSHTIRGDPNATLAQMINALAVDEQDMSSDEATSDGGSSLQHPGLIDQHSIEESTSEESASEDDKNHPEGEAGPQLYNDRRASDASRRTAIASKVADTSASPERDPSDEDPTSSFLSVANARERRPTITRGADENMTSSIYAIHRPIAAQRRTFNGEAGEAIKDGLYAQQGEESEPIPEDHSDEEHDEHPSKLDQGGALLKTRSSRSSTVVSGRSVARKKQLADKLTDIFGLLDSEEVIAEYPCWLFRSVLLQGFLYLTSGHICFYAYLQAKEGAVVRSGGLSVRTARTRRYYRHWFILKDSVLSWYPSSTDPFFPDGHIDLHYCTSVESSKHAEHFKVATAEKRWHFSADSEASRDEWVKTIKKAVFRCQNEGESVKICIPLETVVDLEFSNNLEFAETIRVRVYDSNEGYALDDYWLAYFSDIHLALDEMKEVLETFRKAHPERLLHGEPQSIADTTVEAAAAATGDKPEEQTTNASGLSRISSQHRQGSWSTIRSSRLRLFPSSNHSDRPSPSPLSPADSRGSQTSARTTVSPTRGLSSESSDSDHRYPPYSSLNHSVESAKSPHNWSLPSLSSVSSWVKAPPRLLLQAATSPSLRNASNTKNPCRKIVETISRGPKSASSLGPETDYSLGLEHQETEDASNADEDDEDEKRDERVRKAFGLSEKEHTLAHFSGFLYRGVPIYGKMYITTSFLCFRSISLLAHANMCLPLAEVIGVSHHRSYRIGYSGMVVTIKGHEELFFELHTSKRRDTCMQAIEHQVEFIHKELSEGKTPGDTLAYQEHRTLMDLAASKASDSSEPRPQSESKEGQPPVMFNSTTSDFVTFKPEKSLKFTCMTIGSRGDVQPYIALCKGLKAEGHKVKIATHGEFKKWVEGHGIEHEEIGGDPAELMQLMIAHDFFTIAFMKEAVGKFRGWLDDLLETAWKACQGADVLIESPSTFAGYHVAEALRIPYYRAFTMPWSRTRAYPHAFAVPDRKMGGSYNYMTYTMFDQIFWRATASQINRWRRKTLKLGPTSLEAMQQHKIPFLYNNSPVIMPPPLDWRENIHVTGYWILDNPDDSSSSRWEPPQDLLNFMNEAKEKNKKVVFVGFGSIIIPDPEGMTRTITAAVEKAGVYGIVAKGWSERAASKHDSEEEKQRLKEQEKKQAEVLKKPFIYNIKSIPHDWLFPKIHAAVHHGGAGTTGASLRAGLPTIIKPWFGDQHFYADRVQTLGVGTAVRHLTVETLASAIHKAVTDEKQIDRAKLAGQQIRKEDGVGTAIECIYRDLEYAKSLIPPPPHVLKRKSTDSAGHQDVIAKQADQTAKSSPINPSSSDEASWDVVSGGGSGSASGRGERWDDDEMSELGSTPTKSRGASETRHPSDQGSVPAPIALTTKVLESLGVTSGGSSPK

SEQ ID NO: 7707 - protein, 1498 aa, Microdochium bolleyi
MAPLALDEESSTKRRVSKKLRKTRREGHQPTMELPERFRDDGDDNEEDVRPANNGAQGFMNMNQSIFGLIAAAGSTVDFSDRFDGQSSDEDDEDADSHDSADTKKHAPPGTSSGAHTIVLPKRSDSTDKKEKHHRRSLSGNLLRSLPHLPKLASRSLRKSSKLRSSQLSSDGAKLPSSFSSSQQDSGALSPPLQSPIEEKDRDGARLAPVMSRMLEARAEMSSRPSFDLERRSSDFRRGDDGPSALASKLKEIFDFEQDEEVIQEYPCWLLQSVLMQGYMYITDKHICFYAYLPKKAHEVAKSGYLSKSGKRNPKFTRHWFRLKGDVLAYYRNASNLYFPDGQIDLRYAISASITDKDKDSLHFSVVTHQRTYNFKADSAPSAKEWVKSLQRVIFRSHNDGDSVKISLPLENVLDIEDSQMVEFADTCKIRVIDNDETYAIDEYFFSFFSFGKEAINALKATVEAPVSGKKSKKLRLQINNGSLPGSPLATSAAGSRSHSPAPRGELKSPKLRDHVKATLSPVVPAEASSPRASGDFSRASFDAIRHIGRRSMDLDTAAREASQSKTQQARRSFSASRSLSRSRRPDQSAHTDKLASSESYVQSIEDPSGTSGMIESSNESPSGSQILRGSEVFHSPTLPRRSASGSPAPGHSKTAHRRSQPLKSEPSALRAPGSKAGDTSEDGEVQSLQNLVKMGAYPLQRAGLFANYLNQTSKRMSNLLATESMGYVEKVSGMWKGGRKHYTEQPGLKTEDDEAEDDDDESQVAGATERFQQHFALPPTEKLQATYFGHILRVLPLYGKIYISDRHFCFRSLLLGTRTKLILPLKDIETVDKEKGFRFGYSGLVVVIRGHEEIFFEFNQAEARDDCAVTLHHSLEAARYLRDSETLDKEEKEQAEEAIAERDALNEARLLQNPEHELKLPQPTELGDSSPTILFDDPKASFLNFKPSEPMRITCLTIGSRGDVQPYIALCKGLLAEGHKPRIATHGEFKTWVESHGIEFAPIGGDPSELMQLCIQNGTFTWAFMREASSKFRGWLDELLASAWEACQGSDLLIESPSAMAGIHIAEALGIPYFRAFTMPWTRTRAYPHAFIMPEHKMGGAYNYVTYVMFDNVFWKATASQVNRWRRNLLGLPSTNLEKMQPNKVPFLYNFSPSVVAPPLDYSDWIRVTGYWFLDEAGTWTPPDDLREFIEQARKDGKKLVYVGFGSIIVPDPARMTQEVIDAVLKADVRCVLSKGWSDRLGDNKASAAPEVPLPPEIFQIKSAPHDWLFAQMDAAAHHGGSGTTGASLRAGIPTIVRPFFGDQFFFGDRLEDLGVGICLKKWGANSFARALWEATHSDRMIVKARVLGESIRKESGVETAIQSLYRDLEYSTSLIKSKTGKNAAGGAGDSRMSVDGNSGDNEDDEESWTFVGGGDEADLDFVSKRSSLGGGGAGSPEHTFHGKLESSQSSAGSRALGSKVLGGGSGVGAMRSPGGSSPVATLTHGRSSAGTSRLTS

SEQ ID NO: 7708 - protein, 829 aa, Botrytis cinerea
MEDGKGKEKHDYNKNAQGPPDHYGDSEGVIANGNWHEADNASNASQDLDWEKPPAYEFHGSGPNIKTSVVAQDDGRVAINFIATEKIPIPIPTEPKSYTPPNIANSKSPFLNIVIQIVGSRGELCDIQPFIALGNALRTAGHRVRIATHDVFRDFVKATGLEFFPIGGDPASLMAYMVKNPGIIPKFETIMSGEIPQKRKMVYTMLEGCWRSCIEPDLETNIPFVAEAIIANPPSFAHIHCAEALGIPLHLMFTMPWSPTRAFPHPLANIERSDADLRTTNYLSYALVEIMTWQGLSDVINLWRKKSLSLERIPMTTGPLLCDTLQIPFTYCWSPAFVPKPADWPNYLDVCGFFFREEPDYTPDSELANFLRDGPPPVYIGFGSIVIDSPEKLTNILIKAVRACGTRAIISRGWSKLGSALGEHANPDILFLGDCPHEWLFKHVSCVVHHGGAGTTACGLLNGRPTAIVPFFGDQAFWGQMIAAAGAGPLPLHHNSLDHENLTQAIQYCLTPAAMSAAAEISERMRQESGVQRAVQSFHTNLPVDALRCDILSNQAAVWQYSSKSKKGPKRSAKLSDEAAFILVEHKKIDPKLLKLYQPKPVSIDNLRWDPVSAGTHVLLSTMTNFTLGFSEVFTGPAKAFQSKENGGGGKEAAKTFGKGFGKMVGVLPKATLVDFPLALTEGLHHMPRLYGEEVRDHGKVKDWRSGGIVAGKNFGYGFMDGLSGTITKPYKGAKEGGWAGFGKGVAKGAMGLVTGPGSGMFGLFAYPFLGMYKSIATSSLSPTEKKIILARQVYGSYMATERERIKEGGSSGEEVRVLVEWERLKVDV

SEQ ID NO: 7709 - protein, 1158 aa, Fomitiporia mediterranea
MTRSSSLATVRVKRRTMLAEKLKDVFGIAEINEVVAEIPCWLLRSILLQGYMYLTNSHLCFFAHLPSREDQVLKSGSLNKKTQRTKRWVKHWFVLKNDVLSWYQSSSDPYFPHGVVDLRYAISCETMQEKSFRIRTNQKVITIMADSVPSRDEWVKAIRKVIFKAQNVGESVKIAIPYSVIVDVDRSSAMDFSETIEVKVIDQEEKPSVGSYDSYFFAYFHNVSAALDQIRDAVKKYKPFSHGIPPINEVVHDTTHAAASSDRAGSIQAEQSNKNGYGLKFPSFLRPFQSDSGPISSTPTQSSIQPKVQDTHSSRSSYQFPPAVSTESATQGSQLDVPASGSMKSVNTVHTYPPPPSPPSELTPIASRESSGTTSSWGMPNWLRSPRRAFVTTSTSSSLGTIGQKGVFEVVSGPSSSSRTIDRGLSDFGFSVLEPKNVAEPDVVEKFRTTFAFDEKEQLLGYFPGYLFRLLPTYGRLYISTNFFCFKSSGPLATRTRMQLPIRDILSLEKTKAYRFSFVGLVVIIKGHEELFFEFNSSDRRRAFVSLLERQMEVVQARDTSGEMQNGHNAKPDALLLDEIEPAALFGDEDPRIPSDSTAEDLPAVMFTSTSSTFLTFKPRHPLHFTCLTIGSRGDVQPYIALAKGLMADGHKVRIATHGEFKDWIESYGIEFGYVGGDPAELMRICVENGMFTVSFLKEGIQKFRGWIDDLLKTSWEACKGTDVLIESPSAMAGIHIAEALRIPYYRAFTMTWTRTRAYPHAFAVPEHKMGGGYNYMSYVMFDQVFWRATAGQINRWRRETLGMSSTNLDKLEPHKVPFLYNFSPTVVPQPLDWPEWIRVTGYWFLDDADVSAEKWSAPKDLVDFIDSAHQAGKKVVYIGFGSIVVSDPEAMTRCVVEAIIRSGVYAILSKGWSDRLHLKKGADVSEPEVPLPSQIYTIKSIPHDWLFKRIEAACHHGGAGTTGASLRAGIPTVIKPFFGDQYFWGDRVEALGVGSCVRKLSVEALSEALTLATTDEKQIAKARLVGERIRSENGVATAIESIYRDLEYARSLVKAPRRSTSADEDETIRERQRPSSASISTTISSPQSITDSYLEAQEAQSEDWSVISDSDDRRSSRNSSDLRTHSPNSKRNSLAAVVLSVLPDALQPGSPKNNPRT

SEQ ID NO: 7710 - protein, 1474 aa, Colletotrichum spinosum
MPPPPLSLPLHGPAGAASVTFAGDEDVKKRVGKKLQKKRHEPTTPAVELPERLKEGDDAGEEDLVPTQGPPMFMNMNQSIFGLIAAAGSRVDFHDRFESSDDESADEGPQRDSADRSHSSSTHGLFLHRKQRRRDESDVAKTTVLNKDPYGSGKPEKHKRKISGHKLLRSLPALPRLPRHKSKKESSKLEPPSEEASDGSGFAQSQPVDEAEDDEDDKDHRLAPVMSRMLEAKAEMSARPSFDVERFSSDQLTYSESADSNDTALARRLQDIFEFDQPEAVIEEYPCWLLQSVLLQGYMYITAKHICFYSYLPKKALEVVKSGYLSKSGKRNPKYNRYWFRLKGDVLSYFKDPSNVYFPSGQIDLRYGISASVTDKKDGLNFTVVTHHRTYHFRADSAPSAKEWVKSLQRVIFRSHNEGDSVKISLPIENVIDIEDTQMLNFADTCKIRVIDNDETYAIDEYFFSFFSFGKEAISVLKILIEDASSTAKDAARLKAVQEEEDRQQQQQQHPMQQPMQASARSSMSGSRRAIAPPKLTTNKLPEAVKATLSPMSAHSPSALSPRASMDAARASFDAFRSFRRRSLDLSTIIRDSSPRRSFSGNRRSMSRNRLDDQRRGPHQQGSTDSYVQSSMEDPSFSGMVASSIEDPSASQILRGSDVFQNPTMRRSGSASRTEVEKQQRRDPRSPPTLATYSGQHAATAGSLNDGDKQPVTPTLQSITKMGAFPLQRVGAFAEYLNNTSSKLGSMLATESMGYVEKVSGMWRGGRKHYDAPPEIKTDDEDLYEDAEGKIQTSMDRFRAHFALPETEKLQATYFGHILRVLPLYGKIYISDKSFCFRSLLPGTRTKLILPLKDIENVDKEKGFRFGYSGLVVVIRGHEEIFFEFGQAEVRDDCAVTLLQSLETTRYLEKIGDLDTEEREDEENAMAERDALKEARQTEEFHDHDVHLPKETSGVSDAPTILFDDPKASFLNFKPPQPLKITCLTIGSRGDVQPYIALCKGLLAEGHKPRIATHGEFKDWIEGHGIEFAKVEGDPGELMRLCIENGTFTWAFLREANSMFRGWLDELLVSAWEACKGSDLLIESPSAMAGIHIAEKLSIPYFRAFTMPWTRTRAYPHAFIMPEYKMGGAYNYMTYVMFDNVFWKATAHQVNRWRNNTLKLPNTSLEKMQPNKVPFLYNFSEYVVAPPLDFSDWIRVTGYWFLDEGSDWVPPQELTDFIAKARADEKKLVYVGFGSIIVNDTAKMTQEVIDAVLKADVRCILSKGWSDRMGKQGEEAVDQPVMPPEIHVIKSAPHDWLFSQIDAAAHHGGSGTTGASLRAGIPTIIRPFFGDQFFFGSRVEDIGVGICLKKWGAISFARALWEATHNDRMIVKARVLGEQIRSENGVDSAIQCIYRDMEYAKSLIKRKAGKNIQVEPDEDEESAEESWTFIGNDEPDPDMTTKKLSEMPTLPGSSDTKPLGTRIMRVSPSQQSVA

SEQ ID NO: 7711 - protein, 1392 aa, Verticillium alfalfae
MAPTHPSLPAISTALSPTTASPNSAQPTPTPTDEDPKRRVARKLRRKRRNETYAMDLPERLKGGNDSEDEEDLMPAGNTQNGPPMFMNMNQSIFGLIAAAGSRVDFHDRFEGQSSDDDDESGHQTTKPDKHTATSPEPESNPVQNDRHGPKRLRNAVIVGPARQATSLPALFRLCLASGNGGPRKNRQSWSPPSEDASESSVPQSSLHESAEEDQDQYKLAPVMSRMLEARADVASRPSFDLDRLTSEHSRRDSSDLGPSPLALRLAEIFEFTKPEEVIEEYPCWLLQSVLLQGYMYITARHICFYAYLPKKATQHEVVKSGYLSKSGKRNPKYNRYWFRMKGDVLTYYRDPSNVYFPSGQIDLRYGISASITDKDKAGLHFSVTTSHRTYHFRADSAPSAKEWVKSLQRVIFRSHNDGDSVKISMPIENVIDIEDSQMLQFADTCKIRVIDNDETYAIDEYFFSFFSFGKEAINVLKIMFEGASAETKDPADLPKGASARTSIAANRRSIGPDKIGIARLPENVKATLSPMSPTSPLGPSPRPSADVARPSMDAFRVFGRKSLDLSSVTRDASPRRSFSGSRSHSRNRLEDSRNTVDKNESSDSYVQSSMEDPSFSAMAASSNEDASASQILHRSDVFQSPTMRRSGSRTRQSSKKTVQGTQSPPALATYSGQHAATTGSIADDPNKGPSLQSITKMGAYPLQRVGAFAEYLNSSSRRMSSMLATESMGYVEKVSGMWKGNRKHYDAPPETRTDDEDLYEDSEGRVQLSTERFRAHFALPETEKLQVTYYGFLFQVLPLYGKIYISDRFLCFRSLLPGTRTKLILPLKDIENVDKEKGFRFGYSGLVLVIRGHEEVFFEFSQRDAREDCFGHLLKSVERSRFLHNSGMLNREDKEDAEYALAEREALKEARQDEFHDHEVKLPEQTSCLSDAPTILFDDPKASFLNFKPAQSLKVTCLTIGSRGDVQPYIALCKGLIAEGHRPRIATHAEFQPWVESHGIEFAKVEGDPGELMRLCIENGTFTFSFIREANSMFRGWLDELLVSAWEACQGSDLLIESPSAMAGIHVAEALGIPYFRAFTMPWTRTRAYPHAFVVPESKLGGAYNYMTYIMFDNIFWKATAGQVNRWRNKTLKLPNTNLEKMQPNKVPFLYNFSPSVVAPPLDFSDWIRVTGYWFLDEATKWEPPKELTDFIAQARADDKKLVYVGFGSIIVNDTAKMTQEVIDAVLKADVRCILSKGWSDRVASSGDAGTDDAAATSKREEPVMPPEIHVIKSAPHDWLFSQIDAAAHHGGSGTTGASLRAGIPTIIRPFFGDQFFFGNRVEDIGLRACSVEATHNERMIIKARVLGEQIRKENGVESAIQCISRDMEYATSLVKRKGDKNRKGSPRPAG

SEQ ID NO: 7712 - protein, 1168 aa, Geotrichum candidum
MIKHFSFNSQKDSPKLETSKSDDSEKRASSQDLASQAGVSGQTFIELLTQSVRKDLSLNQNNSNYEGDDESVETLSQISVTSGDNKSLSPTSSTISDDSELKANQTTAIEDNGEKVLAPKPKTNENTEKEATSASEPDAKRSSSTTTEATPCQENRLRVQAISDTLRNKLGCGNATILAEYPCWLLKNILLEGKLFVTNKEVFFLSVLPKKHRQVIQSGSISISRRKNGHYNRYWFVLKNGTFSYFNSFTDQYFPVGFIDLQYAIKADAEVHSDGTLEPSTFRVVTEKHTYHFKTDSDTNAHEWVRALQKEIFRIRNEGDEVKIRIPLNNILDLENIKVLSIIDALRLRVVDSSETYNISEYVLAFLHGIKSDEHPDQDIRDAMKDLGITELSTEDPEKIASHRQVLTISDSTYSGPSSPVNMSPPGTPRRSDSLPRGSSAQRSSSPGALSSIGRKVSRRLTNLVAPSRVTSHTRESNEHEDKHKVSSDDSDESPERLLKIPSFSLPNKVTEIMNTNTVKHFGRTRFPSGDKYLASEEEQKESTKHFLQHFSFESEELVASYHVYLQKGLLIYGKIYVSENYVCFKSIFPNTKTIMIVPNREIQDVLPESGCRFGHSGLVIVGQYQSEIFFDFNGERYRNDALDVIKKARAISKKRNPSIVPEVNEHVKQLRYARMLTYQDSVSDLSAKELHHTGIVETTFEAMTPERPARPLKFTLLTIGSRGDVQPYIALAKGLMKEGHSVRIASHAEFRPWVEKHGIEYAEIAGDPGELMKLMINHGMFSYAFLKDAITNFRGWIDELLATSWEACQGSDVIIEAPSAMGGIHIAEALGIPYFRAMTMPWTRTRAYPHAFLTPDIKKGGSYNYMTYVLFDNLFWKGISSQVNKWRKVSLGLEKTNLDRMSQTKIPFMYNVSPSVLVPPVDFSDWIHVTGYWFLDEGNEEFEPPKELVEFIEKARADNKKIVYIGFGSIVVPKPAELTKAVIKSVQAAGVRCVLSKGWSDRYGAKDNTVPEVELPFDIYQIKAAPHDWLFPKLDAAVHHGGSGTTGASLRAGLPTIIKPFFGDQVFYGSRVEDLGVGICLKKLNVSNFSKALIEVTTNEKMIAKAAEIGKDIRKEDGISSAITTIYKEMAYAKSLIKKEDLQSVESFESEEKHDSFLLRELEALKT

SEQ ID NO: 7713 - protein, 603 aa, Talaromyces islandicus
MPDNIGIEAPERHAGPFVADVIIANPPSFAHISCAEKLGIPLHMMFTMPWSPTRSFPHPLANIRSKDVKSSVANFTSYFFAEIMIWDGLGDLINHFRKKDLGLDPLDLSLAPSFIHKLKIPYSYLWSPALLPKPDDWSDNIDICGFQFLTSDTNYQPPQALQEFLDAGEPPIYIGFGSVVIKDPLRLTSTLFEAIRQTGQRAIISKGWSNIGADISGTPRNILLLGNCPHEWLFPRVSCVVHHGGAGTTAAGLLAVVQAGAGPPPVPYQKLTATNLASAINNAVKSLSKANTQAIGIEMRKENGVQSAVRSFHRHLNVNKSRFSICPNKPAVWWHRRSGIKLSACAASVLVDTGHVGTHDLVMYRPREYNSSRDPWGPLSASAGVLYSLVTDMIGGMVRIPVDILSLHYRKEQMERYRIHKLHDLAVMHFSEVLSQRVRRTENVEDARGASVPIEEHPENGNSSSRDSTTWNIPDTCSEDMDNNNNNNNNNNNNNNTMKITYMSTRQEQQPMTSRNKKFFTDASHYTQGIATELLDFVLRLPTDITLKTPKAGFTLPPGNLLESSMTGLLDSSYNPLELFKNAGVEVCYQELEKDLEGHFSSL

SEQ ID NO: 7714 - protein, 1396 aa, Torrubiella hemipterigena
MASSPPHTDADDDKRRNRLQKKRRDISTSTPELPERLQDSDESEAEDGAELTNAMTVNMNQSIFGLIAAAGSRVDFNNRFDGNSSDEDEGFSSSSKQQDLTQTTILSSPGRSKSRGHKKRFSTHKLFKSIAALPKLKSRKREPSKLSQAADGDDDHDEEDDGTMSPPAVTLTTNEHRLQPVMSRMLQAREELSTRPSFDVERGSADLSQSDDEDPSTQLAKRLMEIFEFDEPEHVIEEYPCWLLQSVLLQGYLYITAKHICFYSYLPKKENTVVKSGYLSKSGKRNPKYNRYWFRLKGDVLSYYHESTNLYFPHGQIDLRFGISATITDRDKECINFSVITNQRTYDFRADSAPSAKEWVRSLQRVIFRSHNDGDSVKISLPIENIIDVEDTHMIEFSDTCKIRVIDNDETYAIDEYFFSFFSFGKEAINVLKLLVEDTAGSKLIEREESDSRPTSAQPSHPATPNRSAINVDSIRMRELSENVKATLAPLSPSGANSPRASGELSPLDAFRHGGKSSHDSPRAMSSVMRENRPRRSFSGSRSGSRRRHAADKQTKLESSDSNLLLSSPDDPSCLSLATSGNEDTSASQILKGSDAFQSPTMLQPPAELLTETAMPVREKSGRMKHAATVPVDNLEDSQSREAVPSTPTLQSITKMGTYPLQRAGAFADYLNKTSKRMSSLLATESMGYVEKVSGMWKGGGKHYDEPAGLRPDDDDLEVDSDGKVQTSMERFRAHFALPETERLQATYFGYILRVLPLYGKIYISDRSFCFRSLLPGTRTKLILPLKDIENAHKEKGFRFGYSGLVVVIRGHEELFFEFRLSEIRDDCTVTLIQGLEKFKALQDAGAFDDEDDEEEDEYIAERDALRTARQEEFPDHELSEQQPPPGLPNAPTILMEGGDASFLQFKPSAPMKITCLTIGSRGDVQPYIALCKGLMAEGHKTRIATHAEFQDWIESHGIEFARVEGDPSELMRLCIENGTFTLAFLREANSTFRGWLDELLDSAYTACQGSDLLIESPSAMAGIHIAEKLGIPYFRAFTMPWTRTRAYPHAFIMPEHKMGGAYNYMTYVMFDNIFWKATAQQVNRWRNKTLGLPNTSLEKMQPNKVPFLYNFSPSVVAPPLDFSDWIRVTGYWFLDEGQEYTPPKELQDFITKAREDGKKIVYVGFGSIIVNDPAKMTREVIDAVQRADVRCILSKGWSDRLNPKDDPSKPKPEEPEMPPEIHVIKSAPHDWLFKQIDAAAHHGGSGTTGASLRAGLPTIIRPFFGDQYFFASRVEDLGVGVWVKKWGTNSFGRALWEVTRNERMITKARVLGEEIRKDNGVDVAIQSIYRDMEYARSLIKRKTGRRAGEAEDADDEEEAEESWTFVGGDEPDPDVVTKKLSEGLGKSLGSQVLAR

SEQ ID NO: 7715 - protein, 408 aa, Streptomyces stelliscabiei
MTAGSRGDVAPYTGLGHGLVRAGHEVTLVTHARFEPLVAGSGVAFHALPVDPRAELESERGRGLHRSSTGAGKLYRAAEMARRLVGRMAGDLETAARASDVLLLAGTVAPLGHAIARGLSVPSLGVNLQPLAPTREFAPPMTGVRSWGPVGNRVAGHAVNAAVEWIFTEEVRRLRTEYGLPRTGTVASRRARERLGRPVFHGFSPRVVPRPGDWRAGHDVTGYWWPYDRENRLPAPLLDFLDAGPPPVFVGLGSATVPDPERMSGEVVRALRAAGLRGVIQRGWGELRGEGEDMFTVGEVPHSLLFPRMAAVVHHAGAGTTAAGLRAGVPAVPVPVQFDEAFWAARLVALGVSPTAVPLRGFTPAALASALRRATTDPSYGHRARTLAGELRGEDGVQPVLTALDRLS

SEQ ID NO: 7716 - protein, 1574 aa, Debaryomyces hansenii
MLPKEDKVNSNHFKGVNDAHKTSLYKRLSSSVIPPLTFLNQNPASPNNEEVPGNNEANKDEKTFSDDEDIAHPIGSVGSSNNFLSFLYAGMGKLSDLKGNDASNANEAKDSKLNDNLRSSRNEQANEPEYRREYKLDYDIDESEEDDIESTRDENTLKPKTEDTSVHSKLDPEERLENVVNMLFDDHDESTTALASDPSKGTVFQQSVLKNFDPFRIQQTELLKLKDITLSTEEDESEEQKLKKKFFRLKVADKLKRVFELNDDDYFYGNYNVWLVRDVLLQGHIYLTKESILFFTFLPKRHNTISASKGTTGGFQHHDDSHDVIQSGSLGMKTALYGDTVFSTPLTHRFWVILRNETITVYHSPTDLYFPITLIDLKSCVRAEVIEKGRNDNASPRPDLHRNDSQEVSSGDEEVEFSNMLNSNYQLEDNSENVSGGYWFKVVTKKKTHKFHSDSLYSARQWVNNIVKVVFQLHNSNANNEVIMKIPINDVLSFDLNEVFGASEKNSDSNGGEEKPKVLNVKYLENGSKGRYALSASRMKKELKNKTKKKMKKNSGNEPDELLSENTYFLLFKDGDEVFSTLNEIVNENHHSSNIFRNRHNSISKKYTSEKGSNWNRPFTHKDEEIHIPRAISTLTTDHFQNSIIDQIEEASHRNTHTQNTDLASPRSECGLTHSVSTSPQSKIRKFGKTLITPSKIFSNKSRTESEKSTPDRSQTTSPVQGINLSLSGLKDLNMAFEASQKNYEVSCTRYSHTEENSTNSPSNFQNNTLSKADALSPQIKSPQPLEAGPLNLTDPSEYEDNKKKNSTLSSIGKSIKAMSSIRSKLAAVNHYEQLDENDTYFIRDVSAREVDTRHFQERFSFNNKKQLIASYHCHIIRAVPVFGKVYLGDSEICFRSMLPGVSTRMILPLIDVDTCSKEKGSNIAYSGLVLVIRGYDELFMEFSVQSARDDCLAMILRQLEKNRESGNESSDDNKSAQHGKSGCFQKTPSSAETTKSSNEIKLAQWRIENARLKLFEDKINAAAGLHVPIVLEDSPFYKTEIRPSTSFNFTLLTIGSRGDVQPYIALGKGLLNEGHNVTIATHSDFEEWIVGHGIKFKTIAGNPVELMSLMVTHGSMSLSFLKEASSKFRGWIQELLDTSWKACQGSDILIESPSAMVGAHIAEALGIPYIRAFTMPWTRTRAYPHAFIVPDKKKGGSYNYITHLMFETVLWKGISSQVNKWRRESLGLPRTNLYRLAQYDIPFLYNISPTIFPPSVDFPDWVKVTGYWFLDEGAADDFEPSKELVEFMNKARADDKKVVYIGFGSIVVEDAKSLTKAIVEAVLNADVRCILNKGWSDRNSSPAKDNAEPEVELPEEIYNSGSIPHDWLFPKIDAAVHHGGSGTTGATMRAGIPTIIKPFFGDQFFYSSRIEDIGAGIGLKKLNARSLCTALKTATSDAKMITKAKKISERLKQENGVLNAIEAIYYELEYARSLILAKQHENTKHDLKSGTQTPVVNETNEYFDSDTYDADHDSDKESDHDQTYEQDNHSDYDVANDDNMTEIVEPSLEDGNDTVRIAPDSGNDNTTVTDANK

SEQ ID NO: 7717 - protein, 1577 aa, Xanthophyllomyces dendrorhous
MSQSESDAGRLHRPNDLEGMHRDFGSVRAGTQSLVQAMSAVPWDDADDSDSSGSDDEGETVSVEERRTGSATYAPQSDPAFGSGQAVHEKTNPMRPTHSSRMSSSIHTIHRPVAYSRAISESRTPMLERNKPSFSGHTDASGFKKDHTLPSFHHTDPYLSHTVNPGQHSNQNLDKVLFSHRENGVEKFQADNPTADEQDYEHQTSDKSILHGTREGENVEKEEADGDRAEEELVKGDSIQDESHEQEARSLMSRRHPDKNANTDEHSSIGRRKRKQKLAEKLRDVFNLPDVEPVLGELPCWLLRSILLQGYMYLTTGHLCFYAALPNNAEVSAPNPDLFTSSRAPSTSYASNVIFLVNHIQHKVIKSGPLIKKSRKSLRANKYWFVLKNGVLSWYTSSADPYFPQGNVDLQYAVECEPFGEKALKLSTNRKTLQFSSETVAGRDEWVKALQKVIFRTQHEGENVKIAIPLQAIVDVDKSSNMDFAETIEVKVAEGDVTLAVDSYFFAYFSDLEGSLRKIREVVSSYHSPDARVDLRGTIDSNREHVFDSISEAAQKKRSISQNYPDPTEKSPSTLSSIKSALLHPFGSDKSKNNDAEPLTSGISPRPSSTGSDLLLSTSPLSSVISSRSSSSVGVGITRVGSKDEHVLSEPFTGTPGMIDRSVTPTPADSHRYPPIPVQSDLKQTPTSSSVSSSWSASNLLNRSSTKSSSTTVSSTKTKTSSNPIVSLFGAVKTSRFKPFSTSARQEDLTTGHEAQGLYETVSPKVEIEGDMTGRASEDSSNEDTADYSLMEKSETADQQAEDVSKAFHEYFALDKNEVLIEHLPGFLFRVVPVSGQVYISSYHFCFRSTQMLSKTRMIIPLQDIISIQPQKAFRFSHQGLAIIIKGHEELFLEFSSTKKRDLCKRLLDKQIEEVKTGRVPKPAHEGPSAAMKREAKVLSDLDAKDMNSPTDSNSASTSLETTDNLPPVMFTSASSTFLNFKPKKSLHITCLTIGSRGDVQPYIALCKGLKAEGHRVRIASHGEYKDWIEGHGIEFGYVGGDPAELMRICVENGMFSVSFIKEGLENFRDWIDDLLQTSWKACQNTDLLIESPSAMGGIHIAEGLGIPYYRAFTMPWTRTRAYPHAFAVPDHHRGGSYNFMTYTMFDQVFWRAISGQVNRWRKKTIGISSTTLEKLEPHKAPFLYNFSPTVVPPPLDWYEWIRVTGYWFLDDPEDSSEKKWSPPDGLLEFIDKAHEDGKRVVYIGFGSIVVSDPDAMTKCVIEAVLDSDVRCILSKGWSDRLSAKEDDTQKSEKQKEKEKKEKEEKAKKEAASYPPEIFSLSSVPHDWLFPRIDAACHHGGAGTTGASLRAGIPTIIKPFFGDQYFWADRVEVLGVGSSVRKLNKEHFTAALKTATQSEKQIEKARELGKEIRAESGVANAIQAIYRDLEYARSLIKGPTRQTPPDASSSSSPESSPSNSPRSGPHELPSVSLDDTPDDSDNEVVFRPASSTTSAGNSAKTSSKMTSGTGFAPADAHVSGSSTGEENSDDSWDMVHNDGSHSRSNTTRLAMQSEGNESGRTTLNSLGLGAVVNMFNK

SEQ ID NO: 7718 - protein, 815 aa, Rhizoctonia solani
MASSTYAGYSQAKSEDYPRGYKDWILPYAYDSPPYEQAGPYSQGHRVYHDSDDDTLVQSVTSFGSINPTLGTHTGPGVETSFHDNGRVSMAFSHAFDKPLPKVYGAPVQEVGVDESGFADAPPMNVNIMIVGSRGDVQPYIALGQRLQQHGHTVRLSTHETFRRLVKDAGLRFFNIGGDPHELMSYMVRNPGLIPGFKSMTNGDIGKKQKMVAEILERCYLSCFEPDDDTNAIFVADAIISNPPTFAHIHCAEALGIPLLLSFTMPWCPTAAFPHPLVNVLQNGKTEANVLNYYSYALVDLMTWQGLGRTINKFRTRRLGLQYLSSASAVGMIERCNIPWTYCLSPALVPKPNDWMNHIDVVGFYFLDLAKDYRPPRDLIDFLNAGPPPIYVGFGSIVLDDPKGLTNTILSGIAQAGVRAIISPGWGGLDEWMIKSAGPHIFALGNVPHDWLFQYVSAVCHHGGAGTTAAGLKCGKPTIIVPFFGDQPWWATQIAHRGAGPAPLDHKTLTPEIFSSAIRIALSPVALNAAREVGRMIMREDGAGKGVESFHRHLPLLNMKCDLAPNRVAVWHSVKYKLRLSAFAAQVLAEVGHIKLKKLKLHRSREYDPYVEAVDPVTGTIVPALRSLNDLGRGLVKVPTKPGRGIAQVARASTMAVQGTLQGAAEGVSNMPKLYGSEVREHKRVTGLGSGIAEGTKGLVLGIYDGISDFVTEPIKGFKQDGIYGGVGGLCVGTLNLAAKPAGGALQFVSKPIEGTVRSFAHKETGRDRIVARRAQGIVASELATLQERNEVIEAFVEYKAKRKRDRKGKGKAVA

SEQ ID NO: 7719 - protein, 1396 aa, Trichoderma atroviride
MATTPTPRRGSLGGDDDAGLPRIADTPADLRRDDSTLTAELPEPLQGSDDDTSENVGFAQTSPMAVNMNQSIFGLIAAAGSRVDFNTRFDDGSSDEDDGEGEDEEGSRLKPLGSRHRDLSQTAILGSFPAKDKRLGHKKKLSGHRLLKSFASLPRRKSGRGSGKMWEPTEEVDEPSESSQSPSPKKPSQQLEEEEEDLRVAPVMSRMLEAQAEMASRSSFDIDIERDSSGPDRTDEGEEEGEEEGEASHVTALARKLMEIFDFDEPERVIEEYPCWLLKSVLLQGYLYITSKHICFYAYLPKKTQSVTKSGYLSKSGKRNPKYSRYWFRLKGDVLSYYQDSTNLYFPHGHIDLSFGISASVTDRDKEGVHFSVVTSHRTYNFRAESAPSAKEWVKSLQRVIFRSHNDGDSVKISIPINNVIDVEDSQMMEFSDTCKIRVMDSDETFAIDEYFFSFFNYGKEAIDVIKDLVEDASAEGPTAGKAIAKQEESSNPSSPRAPGSAFRNLTRVDSALTTKLGPGLVADHSTSRSSTKRDSHDEDSRGRSSDNKRSEGSHQGEERISSRMLESSESNLYSSMEEPSFASLNESAFEDPSASQILRGSDVFQNPTMRHSQSSIRDDKESDLQPAVSTPSHAEGSGYAGSVDLPRVSTPTLQSITRMGAYPLQRAGAFADYLNKTGKRMSTLLATESMGYVEKVSGMWKGERKHYDEPAGLRPDEDDLEEDDDGQIKTSNERFRAHFALPATERLQATYFGYIMRVLPLYGKIYLSGGYFCFRSLLPGTRTKLILPLKDIENAHKEKGFRFGYSGLVVIIRGHEELFFEFRQAEIRDDCAVTLLQCLEIDRNLQGSGLLSLASKEEANAAIAEREALKLAGQETFTDREPRVPQSTTHAANILGDDLETSVIQFKAPHSMRITCLTIGSRGDVQPYIALCKGLLKDGHKPRIATHAEFQGWIESHGIEFACVEGDPGELMRLCIENGTFTLSFLREANATFRGWLDDLLDSAYKACEGSELLIESPSAMAGIHIAEKLGIPYFRAFTMPWTRTRAYPHAFIMPENKMGGAYNYMTYVMFDNIFWKATAHQVNRWRNKTLGLPNTGLEKMQPNKVPFLYNFSPSVVAPPLDFSDWVRVTGYWFLDEGGDYEPPQELRDFIQKARADGKKIVYVGFGSIIVNDPAKMTQEVIDAILKADVRCILSKGWSDRITGRDEPTRPLAEEPVMPPEIHVIKSAPHDWLFRQIDAAAHHGGSGTTGASLRAGIPTIIRPFFGDQFFFASRVEDLGVGVWVKKWGTKSFGRALWEVTRNERMIVKARQLGEQIRRESGVETAIQSIYRDMEYAKSLIKHTDGHLETEEDEDTEESWTFVRGDEPDPDVITTKLSEGLEGVALGNNSKASGKA

SEQ ID NO: 7720 - protein, 1424 aa, Laccaria amethystina
MSTLKSSLQPIDTSEQALGIATHADDKPPDSLQGQSRAKRLSTAVEKTVDKLSRSVGGKSALSPSSSPSTRRLFSLSRKVKGHTSAENEGSSFSPSAIPRSSRLVQSATMVPDDSPFIVPPSPPLRPSLSPFRGDGSMRAGTQTLIQALQALPWMTADNDDESNALSPMDMSSDDEDQRPQFQLSSSIHTIHRPLARSRRLSIPDLPKHGIQAHSAVIEEELAPDDTVVSDEEIEPDFEDTSHPSTERPPLLSHQFIPPSTPVETHDSTLFKSMMTRTGSMATVKLHRRARLAEKLRDIYELDDIQEVWAEMPCWLLRSVLLQGYMYLTNSYLCFFAHMPTREDQILKSGSLNKKAQRTKRWIRHWFVLKNDALSWYQSSSDPYFPHGIVDLRYAISCDAVGGKDFRLRTNQRTVILSADSVPSQEEWVKAIRKVIFKAQNMGDSVKIAIPYSVVLDVERSSAMDFSETIEVKVVDKGEQEHYSVDSYFFAYFHDLSAALEQIRDVIRSHRSFPEQETYPTLLDTTVSRSSPPSLQPSTIPLDISLPKAVSGFRLSSLLRPLSDTLSLGRSGSNILPETQGDEYTHISRRGNSSFIPITTSPKSTFSAAQDNIEPRQDPSKSSLQSLPPLNHTYPPSTSRASTYPNESSLSRDSTNSWNVGVPSWFKSRRVFGALACNNRDSPFDSAGVKEVYSVATVSSPGPINRSGGTGDMAFSVLETPDIAVDQEATDKFRAAFAYDEKEILLGYFPGYIYRLLPVFGRLYVSTNFFCFKSSGPLTSRTRMTLPIRDILALEKSKATRFGHHGLIIIVKGHEELFFEFGAEDKRAVFVQLLENQMESVRKRMVAGTSAITSPGKRDALTLEAFETRTSIGSDSDPPPPLDNMSDSLPAVMFTSASSTFLNFKPHKSLRFTFLTIGSRGDVQPYIALAKGLMADGHKCKIATHGEFQAWIESHGIEYGYVGGDPAELMRICVENGTFTVSFLKEGLQKFRGWLDDLLKTSWEACQGADVLVESPSAMGGYHIAEALAIPYFRAFTMTWTRTRAYPHAFAVPERKMGGSYNYMTYVMFDQVFWRATAGQINRWRRDLLHLGPTSLDKMEPHKIPFLYNFSPHVVPPPLDWPEWIRVTGYWFLDDADVSSKKWTPPRDLIDFIDNAHQSQKKVVYIGFGSIVVSDPKTMTRCVVEAVLQSGVCAILSKGWSDRLHVKSSDDVESEETLPAEIYPISSVPHDWLFQRIDAACHHGGAGTTGASLRAGIPTIIRPFFGDQMFWADRVEALGVGTGVRKLTVQSLTEALVLATTDQKQIDRAKSIGEQIRGEKGVSTAIESIYRDLEYARSLIKRHRNEESDGEAETDLSTIRNHDHRVSYSSESYSGYNSSGSVRGAPSEEWSVISDQDDRRSSIGSRRNNKGKRASQRRPLSTSP

SEQ ID NO: 7721 - protein, 1441 aa, Gelatoporia subvermispora
MAEDAPARPPAPRDNSEGSSSSNSTVYGTGRRTESTNDSRGGIIRRAVGMTADRLGRSGSLGKAQLSQSQPTLPTQAPRRLLSLSNKAKGKEKAHTTDSAVHEGDTPAASTQTSTSLAPTLAAAYRRKQHTSTTGEEDSPFITPGSPPLGPSRPDLFRGFGSMRAGTQTLIQALQALPWIEDQDNDDDVVNHDITPTENESDEDDKHGNWLASSIHTIYRPLARSRRGDAQRRSRTSNLSTLSDNEDVPSSQEPEQETIMSEEEIGEDFEPTTPGPSELEPDTHARTLRKPLDTLPELEALDTSVSRGAQTRSGSMATVKLQRRARLAEKLRGVFELDDIHEVIAEMPCWLMRSVLLQGYIYLTDTYLCFFAHMPSKEDQVLKSGSLSKKAQRTKRWIRHWFVLKNDVLSWYQSSSDPYFPHGVVDLRYAITCEPVNDKGIRLRTNQKSIRLTADSVPSRDEWVKAIRRVMFKAQNMGDSVKIAIPYASIVDVDISSAMDFSETVEIKVVDQKEHSFDSYFFAYFNDLPGALEQIREAVRAQREGPGSLLTPHVIDTTTTRPSSQLVDRAQSLPATDSIPKSQSVFRLSSLLRPLQDSFPISRSSSAPEPETEEFTHVNKRGNSSFFAVTSSPKAIPQTTLSGRPGEVDVPDMALDASYHTYPPSPSRSPSSADLHTTPIATKEGTWSVAVPSWLRIPSRRMFSSPVATRPTAEHASMPPPDVGTVPVSEVLTSATSGSSRHGSGAGSGDYGFFSILEAPAAFLDADSVEKFHSAFAFDEKETLLGIFPGYIFRLLPVYGRLYISSNYFCFRSSGPLTSKTKMILPIRDILHSEKSKAFRFGHHGLVLIIKGHEELFFEFSDEDRRSAFIALLQRQKEEVQRRLSAGDTQDPSSATEALILEELGPRKQLSPSSEQSPQPASDAMSESLPAVMFTSNSSTFLTFKPKRPLHFTFLTIGSRGDVQPYIALGKGLLAEGHRVRIATHGEFKEWIESHGIEFGYVGGDPAELMRICVENGTFTVAFLKEGMQKFRGWIDDLLKTSWEACQNTDVLIESPSAMAGVHIAEALKIPYFRAFTMTWTRTRAYPHAFAVPEHKMGGNYNYMSYVLFDQVFWRGTAGQINRWRRNTLGLPGTSLDRMEPHKIPFLYNFSPTVVPPPLDWPEWIRITGYWFLDDADVGSKKWTPPADLQQFLDDSRAAGKKIVYIGFGSIVVSDPKAMTKCVIEAIVESGVHAILSKGWSDRLVKNAAEALVPEEPLPKCIYPVASIPHDWLFQKIDAACHHGGAGTTGASLRAGIPTIIRPFFGDQFFWADRVEALGIGSAVRKLTVENLKQALITATTDIKQIERARNVGEQIRSEDGVATAIEAIYRDLEYARSLVKGGPSDTHPDEHDAEHATIRDFDQHSTPERSRTRSQGSSVSSPRGAASDWSVISDQEDHHP

SEQ ID NO: 7722 - protein, 916 aa, Rhizoctonia solani
MDKPDTPYHMREKSASNIVPKTSETDSTRYSNDENTTKVEIGSISTSPAINYASYKALGKGLTSSANMTPDGRIVITLDLHKKLPDLPKNYANPVREYAVDRVDWHVAPPMNIVIMIVGSRGDVQPFVALGKRLKEHGHEVRIATHGTFRSFVTGAGLRFFDIGGDPEQLMSYMVRNPGLMPGLESLTNGDIGMKRKMVAEYLDGCWKACYEPDEDEDQLSFAADAIISNPPAFAHIHCAEALGIPLQLSFTMPWCATADFPHPLVNILQSNAGKGLTNVLSYALAELMTWQGLGDVINDFRTKTLGLKPLSLRSGAGIVDRLRIPWTYCMSPALVPKPDDWTNHIDVVGFYFLDLASNYQPPDNLKKFLDEGEPPIYIGFGSIVIDEPQEMTQKIFDAIRETGTRAILSAGWGGLFAPDSPNVPEGVLILDKQTGNIPHDWLFDHVSAVCHHGGAGTTSAGLKAGKPTIVVPFFGDQPFWGAMIARAGAGPEPIPQDELSTRKLIAAFEFVKSSRARGAAERMGRQIQNESGVMLGVDSFHKHLPLLNMRCDIDPHKLAEWWSPEYYLRLSGFAVTVLINAGLLDMKKLQRHRTKEYETHKKATDPITGGSIEIMRTVTHYYAGIAQIFYSPIKGIINTTTAIPRGVMNIIGSVSEGFHNVPRIYGSEVRERGPVNDFSSGITEGAKGLFHGYKDGITGLVTEPLAGAKKEGFIGFIKGSGRSYINATMKPAAGIVGMISNPIDGAWKSIQKPWAKKQDSRQLAVRVERGRRAYEASTEEERQGVINAFKRLTKRNATLDRKKTMEAEAKEMLQTDASRKLTLSDDQGGSDEEAGPSNPRPMVHPVRSASPDHFAHSEDEKAPRPPPLPPKGPPQHNTEDEEAAFQHDLDLAIRLSLAEQQGYERGLKAIAEANH

SEQ ID NO: 7723 - protein, 686 aa, Cephalotus follicularis
MTKKPLNVRSRTVELRCVAWRFSQKKDRKKNPSNECLHTLSLSLSLVFSKSNLHRFSESKHKRFSFSLQIDLDRERRQNHQVVSSPAAMAESPDNHSKSSSTSYSEVTVEIGSGSSSSVDCKASGNGGGGGSVNNGGTGSSGTGKLESTSCQPQLERSKTDRQRHPNILAEETAQIFDDKISVQQKLKLLNRIATVKDDGTVEFEVPGDVEPQVLHVGTEDVYNEVVDDEPLDATDLQYIPPLQIVMLIVGTRGDVQPFIAIGKRLQDYGHRVRLATHSNFKEFVLTAGLEFYPLGGDPKVLAGYMVKNKGFLPSGPSEIPIQRNQIKEIIYSLLPACKDPDIDSGIPFKADAIIANPPAYGHTHVAEALKIPLHIFFTMPWTPTSEFPHPLSRVKQPAGYRLSYQIVDSFIWLGIRDMINDVRKKKLKLRPVTYLSGSQGSDSDVPYGYIWSPHLVPKPKDWGPKVDVVGFCFLDLASSYEPPESLVKWLEAGPKPIYIGFGSLPVQEPEKMTQIIVEALEKTEQRGIINKGWGGLGNLAEPKDSIYLLDNCPHDWLFLRCKAVVHHGGAGTTAAGLKAACPTTIVPFFGDQPFWGERVHARGVGPQPIPIDEFSLPKLVDAINYMLDPKVKDRAVELAKAMENEDGVTGAVKAFLKHLPRKKSEPEPSPDPSSFFSFRRCFGCS

SEQ ID NO: 7724 - protein, 1452 aa, Corynespora cassiicola
MASEDRGRHRPSRKLTKKRRESRRVSLDIPERFKDGDDAQDDVTAPRRNNTMSMNQSMFSMIARAGQQSQTDLGAMREVDSGDSDDEAKQPVQYHSLDGAARLSRLSSAHDFRAHQDEDGDKKISHGKHRRILSDNKLLRSLPKLKIAGRKDATSDSRPTDLMSSSQFLPPKSPPDGPSATLSNDQSSANRSTVTPGEEIHVERRKTSDRKVKHGSTAALSKGKGPISLAKRLQQIFEFDDVEEVISEYPCWLLQSILLQGYMYITQKHVCFYAYIPKKHHDVGRTGYLYKRGRSKYNRYWFILRGDVLSYYTNPAELYFPRNRLNLQYAISAEVLDVKDKAKDETTFIITTDERKYQFKADSAASAKEWVRSVQKVIFRTHNEGNSVKISLPIQNVLEIEESTILDFADTVKVRVIDNDETYAIDEYFFSFFSNGQDALNVLRIMINDNDHHQASHSGEQPTSSTPTAPGASRSQPTAALDGPIDSRHIMENVRATLSPLPAPHVGRPSISADSGRSSGDANRRSFDARRSTDVSRSFRQPSHEIRRSFSESRTDKQSRHLPGDRSPLSARPHDSSESATNSFDPGTESSAAVQSIDESNASASQILSRSDVFRAPDIHHPDVTASDKSDSLARHSQDTTRSSGGGKTYPRSPRTFPIVGGKPGHRATFTSPDVEDDTDAQQTAARLSGSSSALQDIASYPLQKASGFAGFLRTRSKKMGNLLATESMGYYEKVSGMLAGGRKHYNTAEGLEPDDQVHGFEEDEDAAKAAENFREHFAFPESEQLQSSFFASLQRVLPNYGKIYISGRYFCFRSLMPTSKTKIILPMRDIENVNKEKGFRIGYHGLAIVIRGHEELFFEFSKAEYRDECAVIILRILESTKYIEDEQSSSSGVDSDDEAAKAEHDLLQEARQGNETGAPIDVSQIVRAADHDRIPLIFDDPLASIVDFKPSEPLTIVCLTIGSRGDVQPYIALCKELLKEGHKPRIATHAEFESWVREHGIDFAPVDGNPAELMRICIEHGMFTYGFMKEANAKFRGWLDDVCSSSWKACQGADVLIESPSAMAGIHIAEALEIPYFRAFTMPWTRTRAYPHAFSAMEKKMGGSYNSLSYIAFDTVFWTAISGQVNRWRRRELGLQNTTLGRMQANARPFLYNFSPTVVPPPLDWPDWIRVTGYWFLDDPTFEPPADLWNFITTARKEGKKLVYVGFGSIVIDNPAALTKTVVDSVLKADVRCVLSKGWSDRLETKDASKPEVPLPPEIFQIKSAPHDWLFKQMDAVVHHGGSGTTGASLRAGVPTIIKPFFGDQYFFAHRVEDLGVGIWLKKINTSVFSRAMWEATNSQRMIVKAKVLGQKIRRESGTQVAIQTIYRELDRARTLIKKHAKQDDDNTDEFDEEWTFVEDDENVNTSHQFEAHQAMVLGRDGAPTGGSPLVLGSVALKGSSARNSESAYRS

SEQ ID NO: 7725 - protein, 1697 aa, Dictyostelium discoideum
MDEFTSDSLTTSRLLRQISHSDSLSSVGSSSNRSNSNYENKINNGIINDFDSTNANDGISNNSNNSNNNNNSSSILKIHQSPQSILSTEQQHQIQQYQQYHQQQIYESGYVPPHVYIFDPDYKSNNDEEDKEKRSLIELNKSTDLSNIKTTTTTTTTTTPPPLMIPENEEENKQLRQEILNELSKSESFTKIKEPGEIYGFCECSLLYNHLTCANLVITSNYLIFLPQQQVDSDYVLENYLYKKGDFFWKKYWFVLTPDSISWYKSSILKETHYPNGTILLSKIVTVDKLDPEETGKPFCLQIMTNTSIHLIQLDTEPQLEHWYHEINRMQKNLNVTIPIGDIVSITMESNAALFFDSLCLTLKKGENCLVTPSSSSNEVYSLLIKLWNRNRGVTVVEPEKQQRLLEFQKTFKLSQGVNLLIETPCVFYQDEEFSYEGVLYATTEGTLYFSSLDSVLIIPESDIYAITIDRKSDNRDALKVYTTDYDVLFFDSIDDIETFFNVISTSLARSNPKIFFSTVGQIPPIDEPKHDEKEHKSTYQTISSGIRSWKIPIPSLPNFSIPIPKSIPIPLFRSKSSSHLDPQNSQQQQQQQQQSSSLQLDDNNNNIVIPHTSNPTTIIPSTSSSSAIPPPPSSTSSTSSTTHEKTIIIQKNSSINSTFHDIFPLLPLDETVIMFQNCSLYYYSYDSNVEGIVYITKSYIAFNPSPLDKQQQQQQQQQQQQPNSSSITSTTYDRDLDTDSDTDSESDFDYPKQSQHDNSVVMVNNNQYKVKEVLMKKALIPIEDIVSVTKERFLLFFNQCVKIITLDHKWIFGSLNNINSFYNLILETWKQIPKTLLDSSSSSSSSSSSSLLSSSPNNNNSDLNINGNSEGSIFTPLESIKIKNKLGLPADEVLITWFNCTNFKGAQLKYGFLYISNNNICFRSKFGFQKRTIVIPLSQVIEIKKYSAFIPNGIKITTASHHEFQFASFIHRNRVYQILYETWLKANNKKSNSSNSLSSSPTITSPLAISPSIASPSITPPSSTPPSSTTPSSTTPTITSPTIHSTLPSTVVYNDIQEIIDGENNSNNNNNNNNTNNTNKSNSFIGNVEEDVDKIKRSIKSLPILKIHSAQQQQQQQPKTTTTTTSTTTTNLISPRLLTPLTITQSPGFSSLVNSPILPVKPLRITILTIGSRGDIQPFIALSLGLKEYGHNVTLATHELYRDLISKEFGLNYQPLGGDPRELMDLCVRNGIFTPKFIKEALSRFRSFIDDLLLTCWKAVQNSNTQVLIATPGCFAGPHIGEVLQIPFFNAFTMPFTRTRTYPNPFAPFASHQMGGVFNLATHVMMEKVLWQPISGQINQWRTETLKIPPWNSSVSINETYRMPYLYCFSKYLVPKPPDWSGEIAITGYWTLKNQANSDSPPDDLIQFLNEESSTENDDIPIYIGFGSIVIDNPTALSLLLIEAIKLSGKRAIISQGWGGLSIDEHNNNNNNNNNNNNGENSDSNKSSLQSNRIYLLKKPVDHSWLFEKVSLVISHGGAGTVAASLLAAKPTIVVPFFGDQFFWGERIKQTGIGTSIPFDILTAKSLSSHIISILNEPSVRAKVNKMSHLLKREDGVKTAIDFIHRYLPFSFIPPREIPFSSAPNSCMGCKQPFTLLHVMKARVHCHCCGKIFCESCTSHKCPIKKYRINTPVRVCDKCFNDLQSNPSSNSFILND

SEQ ID NO: 7726 - protein, 1298 aa, Histoplasma capsulatum
MPPDDESRTAGSSSSSKPHLASTYRLPQSHIPDRLRMGDDEHEDMTAPPAGTAGRGGRAPYMHQSVFSMIAAASSKNDFHNRFDESSDAEDEDADAARLSKDRFLSNDGVDGRRDGSASTSHLLNIAKRDKSSVPNAVEDRGRPHHRKRLSENKFLKSLAKLPHRGNKGKVPAPEPEPELDPTVTSEPSSTKAVRLVAATEAPVLSRMLDAQSRFGESEPLLNPTELPGKPCCQRKELSPSSLLSARLMDIFGFDRPEKVISEYQCWLLQSVLLQGYMYITEKHISFYAYLPKKPHTIIKSGYLSKRGRQNPKYNRYWVALKEDVLSYYMDPSNLYFPSGHVDLRYGISANLAEQKDKDKDTDNNVKDFTITTNNRIYQFRADSATSAREWVKTLQKVIFRSHNDGDSVKISLPIENVIDIEENPVIDFAHTFKIRVVESGESYAIDEYFFSFFECGKEAIEVLKKMANHTPAQHIQQAMLAPDGGHISGCRRSHSVDVISHSSTHETTLLAEAVKATLRPLSPLDSQYGSPKQSQDLPRSHFRTFSRGRRLHSRECSEAGLEQKRSDSTNRASVGDNQDERSAGGKLQNSSDSFVQSLEHATESSAILQSTSGTVESASQILNRSDVFRSPTIHRLQNSLSGSGEAPRRHSEDTARFPPTSADLLPLRTQTTQSLMKQAQQDAGSDSEHDFQLRSVAPSASSPTLQELMKAGSYPLQRAAGFAGYLRNRSKHMSNLLATESMGYFEKVSGMWIGGKRHYGDGETILSEDKMVDPEDEEQGCEHGDRFRTHFALPPSEKLQATYFAYLHRVIPLYEARLEGMDAQQSSPTLSASVLLSSTSSPILFDDPRVSIVQLQAAGGIEDYMSYYRLPSDILIESPSAMAGIHIAEALGIPYFRAFTMPWTRTRAYPHAFAVPEHKMGGAYNYITYVMFDNVFWKAIAGQVNRWRKRELGLRSTNLDKMQPNKVPFLYNFSPSVVPPPLDFCDWIRVTGYWFLDEGANWQPPVELENFIKQARADEKKIVYIGFGSIVVSDPAALTKTVVDSVLRADVRCILSKGWSDRLGDPSSAKAEIPLPPEIHQIKSAPHDWLFSQIDAAAHHGGAGTTGASLRAGIPTIIKPFFGDQFFFGSRVEDLGVGICMKRLNVSVFSRALWEATHSERIIVKAKTLGEQIRKEDGVATAIQAIYRDLEYAKTLVRQRSPTTSAPQTAIYAVSNEESAAMISSETGPDDDGDGEDDADADAAMEDSWTFVGDETETDVTKKTRARERDYDIGLDNVATAGVINGSGGCGSDSGKG

SEQ ID NO: 7727 - protein, 864 aa, Rhizoctonia solani
MILVDDKTGSTEVQAQTELLSQPSSQNNTSEPTDSSLILNIPISYSHESLQEATAQPPPTYSPSVVSREQRTRMFVTNGRPVSTTDLLDSSESTADVVYPREKAHLPEYSEMITTEATVQSDGRIQVLFAPSQGFPEGYAPPVYEPALDEDGFLSAPVMCINIMIVGSRGDVQPYIALGQRLQEYGHTVRVSTHEVFRPLVKHAGLMFFNIGGDPSELTGYMVRNPGLVPNLDSLKGGDIGKSQARISEILDGCLLSCYEDDEGSEEEPGFAADLIISNPPTFAHIHCAEALGIPLHLSYTMPWSPTASFPHPLVNIKQKDETEPGMASYYSYSLVDMMTWQGLGRTINKFRTKRLGLEYLSTRSAVGIIERTSVPWTYCISPTIVPKPADWMTNIDVSGFCFLNMAKGYDPPRELVEFIEAGEPPVYIGFGSIVLENPENMTKSVLGAISQAGVRAIIAPGLGGLDESMIKTAGDEVFSLATDVPHDWLFERVSAVVHHGGAGTTAIGLKCGRPTIVVPFFGDQPWWAVQVARRGAGPPPIHPNKLTAEALAVAIRVAVSPESREAARKIGETIRSEEGPRNAVESIHKHLPLLNMRCDLDSNRVAVWYSPTHKLKLSAFAAQVLAEAGKIDINKLELHRSREYDTHIGPLDPVSGTLFPGLKIVNDFGRGIAQLPSEPGKGATKMLSASTLGLQNTLQGAAEGMHNLPKVYGGEVRKHKKVTGIGSGFAQGGKEFALGLYDGFSDFFMEPVRGFKRGGVLGAIGGVGIGALNLTTKPTAGFMHAVSMPIEGTIKEVKSMLHRQVGKNRVVTRYAQGVSAARNASEAERERVVRAFLERVSGVDSASTKDKKGKGKAKMVWKN

SEQ ID NO: 7728 - protein, 1127 aa, Phlebiopsis gigantea
MGTVKIQRRARLAEKLREVFDVPGIEEVVAEMPCWLLRSILLQGYMYLTDSHLCFFAHMPLREDQVLKSGWMNKRAARTKRWIRHWFILKNDVLSWYQSSSDPYFPHGVVDLRYAISCESSGERDIRIRTNQKTIKLSANSVPSRDEWVKAIRKVMFKAQNMGDSVKIAIPYSAIVDVEKSSAMDFSETIEIKAIDKNEHYSVDSYFFAYFHDLPVALEQIRDAVRTYRSVPGSSSPPPVIDTTASRTPVAPYQPMQSPGIGISPTTLPTPKSSSGSSFRFTSLLRPFQDSLPLMRAYSSQEPPGNEEYTHISKSPSSFVPITTSPVPLQPPSLPGTRSPSLTPTSSNVEHGHTYPPSSSSSYHSELTISSTRESTWTVGMPAWLKMPSRRLLSSPFTTLRPAIEHSTSTPPSSSAAVSEVLSSRHLSMSASGGGGDFGFFSILEMPESTVDEETTEKFRTSFAFDEKEKLLGCFPGYIFRLLPVYGKLYISSNYFSFRSSGPLTSRTTVSIASDAAMILPIRDVLSTQHAKAFRFGHFGLVVIVRGHEELFFEFSDELRRAAFARLLAQRIEDVRHRVAAGEPQPPSAGERDALILEEFGPQVPTLTETEYIREPEAMDSSLPAVMFKSTSSTFLTFKPKQPLHFTFLTIGSRGDVQPYIALAKGLMADGHRTRIATHGEFKEWIEAHGIEFGYVGGDPAELMRICVENGTFTVAFLKEGVQKFRGWIDDLLKTSWEACQGTDVLVESPSAMGGIHIAEALRIPYFRAFTMTWSRTRAYPHAFAVPERRMGGNYNYMTYVLFDQVFWRGTAGQINRWRRHTLGLPSTSLDKMEPHKVPFLYNFSPTIVPPPLDWPEWIRVTGYWFLDDANVSKDKWTPPPDLLEFMDNARKENKKVVYIGFGSIVVSDPKAVTRCVVDAIVQSGVYAILSKGWSDRLVKNAANAQDTAEPLPKEIYPISSIPHDWLFKRIDAACHHGGAGTTGASLRAGIPTIIKPFFGDQFFWADRVEALGIGSAVRKLTVQALTGALIAATTDQKQIQRAKEIGEHIRSENGVATAIEAIYRDLDYARSLIKGAPHTDEEAERATLRDQRSPSPARQSRKSPRSSTSSAHGGTSDWSVISDQED

SEQ ID NO: 7729 - protein, 780 aa, Rhizoctonia solani
MIVNDRIDNYSKFSQGQSTAPNTIYRSSDSGSLSQSYEAVACAAPPPIYSRHRRSDEFALTQGDTSSEAEFAQDLSEKSSKSLRSLSLDAEASFQDDGRLQISFGHRLSKRLPHNYAEPVNEIGLDEVGFRDAPPMNVNIMIVGSRGDVQPYLALGQKLQQYGHTVRISTHETFRDLVKGSGLRFFNIGGDPHELMSYMVRNPGLIPGFESVWNGDIGKKQAMVAEMLDKCCLSCYEADEGSPGESGFVADAIISNPPTFAHIHCAEALGIPLLLSFTMPWCATAAFSHPLVNIKQSGSHEPKAVNYYSYTLVDMLTWQGLGHAINKFRKKKLGLEYLSTASAVTMIERCAIPWTYCISPALVPKPQDWLDHIDVAGFYFLNLANNYVPPADLVEFLASGEPPIYVGFGSIVLKDPQQMTEAVLGGIAQAGVRAIVSPGWGGLDEAMIKEAGPHIFALGNVPHDWLFQHVAAVCHHGGAGTTAIGLKCGKPTIIVPFFGDQPWWAAQLAQRGAGPPPLDSKNLTSESFAIAIRAALSADTIAAAHDISDIINREDGTKNGVESFHKHLPLLNMRCDLDPKRIAVWYSPTYKLRLSAFSAQVLADRGELDIKKLKLNRSREYRTHALPSDPISGTALPLLRVINNFTHGLVKVGSSRPDKGVLKMATATAGGEYTTTVDKAIKLFISFNVIGLQTVLQGMTEGLTNVPKLYGSEVRESKKVTGFASGVVEGSKGLAYGFYDGITGLVVDPVKGFKEKGALGAAAGIGSGGSYSIVKIDRLY

SEQ ID NO: 7730 - protein, 596 aa, Aspergillus niger
MASNRNAEVFELPGDLVMPPTTASNNHPGVFELPGEAVTIPPTPIAADRKSGINITSDGRIDIDYNTTLVRRFSKLYTSHYSPRPTTPPPEYSETALQAANDNGPSLESPPAYTEKTWKIKLNIVIQVVGSRGDVQPFIALGNELQRYGHRVRLATHNVFEAFVRSSGLEFYPIGGDPEELMAYMVKNPGLIPNMRNLQAGEIGRKRAMIREMLDGCWKSCIEPDMATQLPFVADAIIANPPSFAHIHCAQALSIPVHLMFTMPWTNTKAFPHPLANLTGGGDEDQGFRNFVSYSVVNWLTWQGMGDVINHWRKELGLDEIAMFEGPRLAEILKIPFTYCWSPALVPKPTDWPSYIDVCGFFFRESPRYDPPADLLAFIAAGPPPIYVGFGSIVLEDAESTTTIILNAIRAAGVRAIISKGWSNLGGIHDDSNIYFIGDCPHEWLFDRVAAVVHHGGAGTTACGLRKSKPTFIVPFFGDQPFWGDMVAAAGAGPTPIPYKELTVDKLASGIQYCLSEQARMSAVAIAAKMQSEIGVKAAVASFHRNLPLECLQCDLEPNLPAVWSFSQNRRKLKLSKIAAEVLISHGLIDAKHLTM

SEQ ID NO: 7731 - protein, 1382 aa, Cordyceps militaris
MTILDDKQVMARRQAQARADAQARQQSADSLGGPPSTSEESLITDGFVIPSLDVPSEAPPAYGDQVDKVTFSQPGFQAGAAVAGDGRVNINISTKSRRLAELLAPVVDRQVSVAEAQEPLPPAYIPPSLGGLPGQTPPPALNIVIQIVGSRGDVQPFVALGKTLRDTYGHRVRIATHATFQKFVEDNELEFFNIGGDPAELMAFMVKNPGLMPGFDALKSGEVSKRRRGIEEILMGCWRSCIEAGNGLGPPPKPHTRYAPVNFSAHEVPGNPADRPFVADAIIANPPSFAHVHIAEKMGIPLHMMFTMPWTPTRAFQHPLANIQSSNLDDTLTNNLTYTLVEIMTWQGLGDVINRFREKALELPELSPLWAPGLLTRLRISYTYCWSPALIPKPNDWGNNIDVSGFYFLDLASSYTPDPELDAFLNAGPPPVYIGFGSIVVDDPNAMTRMIFDAIHLAGVRALVSKGWGGLGADDVGLPEGVYMLGNVPHDWLFERVSAVVHHGGAGTTAAGIKAGKPTFVVPFFGDQPFWGSMIARAEAGPEPIPYKDLTAEKLATAIEKCIEPGTIEQAEVLGQRIREEKGTDEGGYSFHKHLEVDKLRCSVAPSHAAAWRPTDPVTAGAAAIMLSLGTIGMAIADMPRDLWKSHRKYKKESDSASRPTESSSHLTPSLSNYSTDSGHATWYWSPDTNKAGGPPEVASPKQASLHEEHMSPGMAFGVESAVGTARGVNRIIEAGVKSPMNFCLGLAKGFRNMPRLYNDDLVRPVEKVTDLSSGIKVAGKELGYGFFDGISGLVRQPLHGAEKEGAVGLVKGFGKGIGGLILKPAAGIFGLPGYAMQGVHAEFGKHMSRSVYNYIISSRIKQGEQALMKASEGECEDILRRWNTVKFDLSSFYDLKRRMGGTEGPFPPPPPLPTDDSSDTVSIMDKGFSKPRTGWLQTRHLSSAQRKRMQDEKQTWKRGYVESLVPAAPTFLPEKEKAVQATNMSQEEDEVERAIRASVRETSQGVQEDDAEIEAAIRESLRVMRQSGALPATGWIDEKNGRNNDPSIFEDEEFKITDEEFQDLIQGAMRQSLVEEYGYPAGELGFPGPSSSSFTGTSRPALTEEPAPMDDLYGGAEAPGYQREAPTHASSMSQQHAVDEEELELQRAIAASKQELQRAETERNEEDIVLEYIKKQSLAEEEFRKRSKGKGVSTNYDDDDDDDEDMRLAMEESLKVSHGGLGQDLPTERMCRQDWIITYWLCKCTKTSFLQLIADDGCGFCGTPSGAERLVNATTERVPCESSQASPHKGHILGERKSNMCRQDWTYIYWMCNDIKDKSFVLTPERGCGGCGEVTADSFFPANRILPSPCPECVESQKWISMDGIWMPRDLAESRGWKPPP

SEQ ID NO: 7732 - protein, 1250 aa, Kazachstania africana
MANSDSSSQPQKSQEGKTTKSKEASVLLSKPVKILSSTKAATPAISKPIQVTGQGISSSISALKRVKNEGIEYTNALGSIVISPVAKFNHENVQNEEDDLAKSKYMMKSIAGLLTTASVYAGMNIAQSAEDLAEEDKIVKSSETLDLPNAPLEQRKPTLFELSVVPKINNRDVAQRDADDNGIEYEESTKENIKWKLQRKFNLDQDEEFQYGSSAWLLKDVLIQGHVFVTSKHLLFFAYLPKTSGEVKMTGHLNVKAKLKGSNRYWCILKGDIFSLYSSPTEIYFPILTIDLRNVTLIEIQKNSNNTELASNFKLVTEEKTFRFNADSPYSAKTWCNALRRQRFTAENSENNSLSLKIPISNVMEIDDQKMTNESSILRVRALESRETFAVDDYIFMFLDTAGDQLKGKLEGQISELKLNGTKTIYNSDPTAIVNKQQDKLIQANKNSDDNATKNYRKHSSSSPIRYLPLVRKITSKKLLDEPPSAKAEQKSKIQRFRSKSNQLLRRSHNTDDTRIEESIIIESYSTPSALEIQQSPSDTPIPGSYSPSSDDHSTRREKLTEWTSKPFKNVAGMWSAKPTHYDNSWVKFPESKHLFVVKGKELVNANKRFRFHFNLKKEEVLLSSYYAHLNRNVPIYGKLYLGDDVLCFRSLLPGTTTKMVLPLTDIETCYKEKGFRFGYYVLVLVINAYEELFFEFSNEATRNDAESILLERVEKLKVVKIDSATVAENYIETDSENAKLKFFEDKIAAQGFEVPLLVDQNPNFKTTIVPNKSYSFGLLTIGSRGDVQPYIALGQGLIKEGHQVTIITHREFKDFVENHGIKFKELAGDPAELMALMVEHESMNIGMLRDASSRFKGWIKRLLQTSWEACKTSNFDILIESPSAMVGVHIAEALQIPYFRAFTMPWTRTRAYPHAFIVPDQKRGGNYNYLTHVLFENVFWKGISGYINQWRVETLGLNKTNLYLLQQNKVPFLYNISPTIFPPSIDFSEWVKVTGYWFVDEKETYAPTKELESFIKKARNEGKKLIYIGFGSIVVSNAKEMTKALVEAVVEADVYCILNKGWSERLGDKSAKEVEIELPDCVFNAGAVPHDWLFPQLDAAVHHGGSGTTGATLRAGLPTVIKPFFGDQFFYSNRIEDIGVGAALRKLNSKSLANVIKKVLTDERIIEKAKIIQKQIAKENGVRTAINCIYSELEYARSLIASKKANRRMSLPFNFETVTSVAETGVNSATNVVTNMIPSFNVDDSWILL

SEQ ID NO: 7733 - protein, 1390 aa, Exophiala oligosperma
MASLEGASKWRDTSKRTDSHKAQKRSPRFTRLSSPGMPSRLSLGADAHDDVTAPSRGRNAPAQYMNQSIFSMIAAAGSRTDFNARFDESSDSEEEAAQTKSSFVDSKGTSVNERHVARAAVTKDDALSSTKSSTYSSLVHPSENLPPSASASRLKDKAPAIRQDFGPGSDSASDSGKSNPRDAPLLSKLLTAEAEFTESGGHPPSMPLIDAVPEAVLATRLMEIFGFDEPEKVLAEYPCWLLQSVLLQGYLYITTNHICFYAYLQRKSHQVSKTGYLAKKGRTNSKYKRYWFSLKGDVLSYYSNPSNLYFPSGNIDLRYGISAHVSSDKGKQKECKDFCLTTDHRTYHFRADSASSAKEWVQTLQKTIFRSHNDGDSVKISLPVQNIIDFEESPVVEFAETIKFRVLESEDSYAVGAVDEYFFSFFSFGQDALQNFRTLLPEADGARTSDDGLLSAARKDMSTFSPQDKADVHDLPRRGGPPAQSPPALKESVRATLLPHPLPESRNISPRVSGEFSHGDSPSRSSGEYGRGSFKRGRRSGSTSRLETNIPRRPHSPFAQHHDSEDSYVHSIDKETDSSTAPLSPRAEAQMSASQILDRSDLFHPPVVHRMTTLASMSSEGHSEGGTVLSTSHPNDATSPVPMRGAGTYGKNKQSGSKEEGIVKTDSPTLQEFVRAGSYRLPRAGQLAGFLKNPSKSVLKYLPTEPMSYIEKVSDMWSGDRKHYGDNEGVVPGDKGIDPEDEETNVGHGDRFRAHFALPSTEKLRATYFAFLHRVLPLYGKIYISNRKFCFRSLLPGTRTKLVLPLRDIENAAKEKGFRFGYHGLVLVIRGHEELFFEFSSSDHRDDCTVTLLHSLESVRDMAESGMLAKEEEDDAEAAKEEHRMLQEARRSSTGDHQLVLPDTAEAIYSHEDTRPILFEGPRASISSIKPTTPLKITCLTIGSRGDVQPYIALCKALLAEGHKPRIATHAEFGPWVLKHGIDFAPVEGDPAELMRICVENGMFTYSFLREASAKFRSWIDELLSSAWQACQDSDLLIESPSAMAGIHIAEALKIPYFRAFTMPWTRTRAYPHAFAVPEHKIGGAYNYYSYVMFDNVFWKAISGQVNRWRKKELGLRSTNMDKMQPNKVPFLYNFSPHVVVPPLDYPDWVRVTGYWFLDEAQDWTPPAELQKFIEKARKDGKKLVYIGFGSIVVSDPAALTKTVVESVLKADVRCILSKGWSDRLGDPTAVKTEVPLPADILQIKSAPHDWLFRQIDAAVHHGGAGTTGASLRAGVPTVIKPFFGDQFFFGSRVEDLGVGICMKKVNVSLFSRALWEATHSERMIVKARLLGEQIRKVSFKSSRVYSEMRNELTFPPGERSADRYPSHLPGFGICQIHRGGKSKQTRSSC

SEQ ID NO: 7734 - protein, 1439 aa, Scleroderma citrinum
MSRLVPRKARSPIASPVHQDVPLPDGTEQGQDASPQERIRRLATKTIDLGKCITGRPHPPPPASKGSRRIPNTNKKGKGKETSREDPTEAFSHSTPLSQPQSREHTSIHQVSSPASSDDSPFIRPPSPPSYPPHRPSLQEIQGVGSMRVGTQTLIQALQALPWGDDPDNEDDPGSATTPNIDSDDDTTPHIASSIHAIYHSVEWARRAMSSLSIRSTKRLVQGDLQGESDSDAEMNLAFEDDVEVDDFETATPRPADIQKPEPLPSAPLHMTVHLAASIRRRSVSRSGSMATVKVNRRALLAEKLREIFDIDALTEVWAEMPCWLFRSVLLQGYMYLTNSHLCFFAHMPSREGQVLKSGSLSKKATRTKRWIKYWFVLKNDALSWYQSSSDPYFLSGIVDLRYVLSCESVGERDIILRTTQKTVTLSADSVPSREEWLKAICKVIFKAQNMGDTVKIAIPYRVIVDVEKSSAFDFSETIEVKIVDKDEKDSYFFAYFHDIQAALEHIRDAVRLHRALDPGSPQVVLDTTAARPTVVTAHGIDRARSLPTAESKGSYSFRLSHLLRPFHDPFPLPLGRAYSAPDPPNAAEEYEHISKRGSFVPVATSAPGNDLTSPITNNPVFPADSSLPLRDHTYPPSSSPGESSSSSQGKILPLGVPWNVGVPSWLRSARRTTAPGGSVSLTVSVSQNLGSVHEIYSSPVTSFPDQSNGAPADLGYSVLETTEAMVDGEIMEKFRTAFAFDDKEVLLAYFSGYLYRLLPVSGRLYVSSNYFCFKSTGPLSQKTRMILPLRDILNVEKSKATGFGHVGLIVVIKGHEELFFEFGTDDRRSAFISILERQLEDTRKRPCNVVVPKLSEGQRHALILEEFDPRLSSSDADPVPAPENMSESLPAVMFTSASSTFLTFKPKESLHFTFLTIGSRGDVQPYISLAKGLIADGHRCKIATHGEFQAWIESYGIEYGYVGGDPAELMRICVENGTFTVSFLKEGLLKFRGWLDDLLKTCWEACQGTDVLVESPSAMGGYHIAEALRIPYFRAFTMTWTRTRAYPHSFAVPEHKMGGGYNYMSYVMFDQVFWRAISGQINRWRRNVLHLDNTSLDRMEPHKIPFLYNFSPTVVPPPLDWPEWIRITGYWFLDDAEVGAKKWTPPDDLISFIDSAHQAGKKVVYIGFGSIVVPDPEGMTRCVIDAVTQSGVYAILSKGWSDRLHAKSSEASKPEEPLPKQIYPITSIPHDWLFQRIDAACHHGGAGTTGASLRAGIPTIIKPFFGDQFFWADRVEALGIGAGVRKLTVESLKDALVSATTDQKQIDRARLIGKQIRSEKGVEVAIEAIYRDLEYARSLIKRPPSAVEEVEQGPTVSEDPVPRPRYDSAGSHPGSEDWSVISDLERRSSFGSRRSDGKIDPSSLHKRNSLTAAMMSVLPDSFTSQNHRRCSSASCRRA

SEQ ID NO: 7735 - protein, 824 aa, Talaromyces stipitatus
MTHSSKFMLALGRGGLDSMRGGGKKKEDQSSAEPSFQSDPSNPGAWDDDLDPPPDIDWDEPPVYELVGSGNRASTTVVAQGNLLSAKRLSISAPAQPKPYTIPNIINSKSPRLNIVIQIVGSRGDVQPFLALGRELQIEGHRVRIATHDVFRDFVTEAGFEFFPIGGDPSSLMAYMVKNPGIVPKFETIMSGEISRKRRMVYRMLEGCWRSCIEPDPENNIPFVAEAIIANPPSFAHVHCAQAMGIPVHLMFTMPWSPTRAFPHPLANIERTDADPMTTNYLSYGLVELLTWQGLSSVINGWRRKSLGLDPVPTLTGPSIAEALQIPFTYCWSPAFVAKPQDWGNYIDVCGFFFREEPAYTPEDELRDFLSSGPPPVYIGFGSIVMDDAEKMTAILLGAVRTCGVRAIISRGWSKLGSSQQDPNVMFLGDCPHEWLFKHVSCVVHHGGAGTTACGLLNGRPTTIVPFFGDQAFWGQMIAAAQAGPSPIHYKSLNENNLAEAIRYCLMPKARNAAATISRKMKADNGVRAASRSFHCNLPVEALRCDLLPDEPAVWLYTKKKKTLKLSDKAAFILTENNKIEAKHFKLYQPKPIIIENQRWDPVSAGSSVLLGMLFDFTVGFSQVFTGPAKVFQSKEEGGGKKEAAVTFGKGFGKMAGVLPKATLVDFPLAITEGLHHLPRLYGDEVRNHGQVKDWKSGCGVAGKTFGYGFVDGLFGTVTKPYEGAREGGWAGFGKGLGKGAMGLVTGPGAGMFGLFAYPFLGMYKSISTSSLSPSQRKILLARQVYGSYMARQREYAAQDGGQEWDEATQNIVLEAFERRVKRG

SEQ ID NO: 7736 - protein, 1428 aa, Coprinopsis marcescibilis
MAHKPSLQPLLHDPMAAPTLDTSVDALGMGEAPETEEPKLTQSRVKRLSSAVEKTVDKLSRSVGSKSTPSSPPPATGHRRVFSLTRKPQNLAAEGESPSISPARSDIPRPQSGLAASKPSSMPPTATDDSPFITPPSPPLRPTTLEQFRGDGSMRAGTQTLIQALQALPWMMNDADDETGANDVGQSDADSDDERPGFKRLSSSIHAIYRPLARSRRLSIPIKGKGKGRSSSPVIEETTPDDLSSSEEEEREPDFEEEEGKLQHTRPQVVQHQSLPALTIDDRSLFRPRPDRAGSLSTVRLHRRTRLAEKLREIFELDGIQEVWAEMPCFLLRSVLLQGYMYLTNNYLCFFAHMPTREDQILKSGSLSKKAQRTKRWIKHWFILKNDALSWYQSSSDPYFPHGILDLRYAIACEAVREREFKIKTNQKTIVLSADSVPSRDEWVKSVKKVIFKAQNSGDSVKIAIPYSVVLDVERSSAMAFNETIEVKVVDKDDQYSVDSYFFAYFHDLPAALDQIRDAIRTHRVLPEHQAEQTVLDTTVPRSPQNPPNDRPSASVSDSFVPKSVSGFRLSSILRPFSDTIPFTRATSVPAPESQGSDDFTYITQRGTSSFIPFVNSPRATIRRPPLSETQSQPSDSQSVPTPDHTESNSLWNMGVPAWLKPSRRVFGSSVSTQTDASASSDSMVVKELYSSPSPSTLASVGRLAAVGPGDMAFSILETPAIPVDHDIAEKFRSAFAFDEKEVLLGYFPGYIFRLLPVYGRLFVSTHFFCFKSSGPLAARTRMTLPIRDILALEKSKATRFGHHGLIIIVKGHEELFFEFGAVDKRDAFVRLLEKQMDDVRVRLAVGEAMEPTTGKKAALALEEFESRTSSSSGDSDPAPPPDNLADSLPAVMFTSASSTFLTFKPNKPMHFTFLTIGSRGDVQPYIALAKGLMADGHKCRIATHGEFREWIESYGIEYGFVGGDPAELMRLCVENGMFTVSFLKETLHKFREWLDDLLQTSWEACQGTDVLIESPSAMGGYHIAEALKIPYYRAFTMTWSRTRAYPHAFAVPERKMGGSYNYMSYVMFDQVFWRATAGQINRWRRNSLHLGPTSIDRMEQHKIPFLYNFSPSVVPPPLDWPEWIRITGYWFLDDADVGSKKWTPSPSLVEFIDNAHNQGKKVVYIGFGSIVVSDPRTMTKCVIDAVLKSGVYAILSKGWSDRLHVKLADASEPEEPLPPQIYPISSVPHDWLFKRIDAACHHGGAGTTGASLRAGVPTVIHPFFGDQFFWADRVEALGVGTGVRKLTVKGLTEAFVAATTDQKQIARAKLVGEQIRKENGVAVAIESIYRDMEYARSLIKRQPLEEDIDEDFEQSTIRYQGLSSPFTPGSFSGFSSGGSAHGSPSEEWSVIDEDERRSSVGSQLSDSRIRRDKPGSPPPARSPISSP

SEQ ID NO: 7737 - protein, 580 aa, Oryza sativa
MRGASGGGEGFVGASSVSNNISLPNEGTSPRGTDNAECSETSSDRSNSESIKPEECAMPSSIFDKKISIKKKLRLLSRMAILKDDGTVEVDIPTNAEAASLDLSSNDYCNEAFSGEPLASSDFQHRPPMQIVMLIVGTRGDVQPFIAIGKRLQIYGHRVRLATHANFKDFVVTAGLEFYPLGGDPKLLAGYMVKNKGFLPATPSEIPIQRKEIKEIIFSLLPACKDPDTDTGAPFNVNAIIANPAAYGHVHVAEALKVPIHIIFTMPWTPTCEFPHPFSRVKQPAGYRLSYQIVDSFVWLGIRDIINDLRKRKLKLRPVTYLSSAHAYSNDIPHAYIWSPYLVPKPKDWGPKIDVVGFCFLDLASNYKPPEPLLKWLESGEKPIYIGFGSLPIPEPDKLTRIIVEALEITGQRGIINKGWGGLGNLEEPKEFVYVIDNIPHDWLFLQCKAVVHHGGAGTTAASLKAACPTTIVPFFGDQFFWGNMVHARGLGAPPVPVEQLQLHLLVDAIKFMMDPKVKERAVELAKAIESEDGVDGAVKAFLKHLPQPRSLEKPQPAPPSSTFMQPFLLPVKRCFGIAT

SEQ ID NO: 7738 - protein, 436 aa, Unknown
  Description of Unknown: Agrobacterium radiobacter K84 sequence
MRIAIFTIGTEGDVRPLVALALGLQQAGHQVRIATDPSCADLVRENDIEYACLNGDFLAWMRSDQRTMERGLASFAIMAEARRRLLAMAVDWAEQGRAAAQGADLLIGNGMVYYLTASLGERLGVPVVESQLMPTLPSHTSPPLPLPQWMYRLPGFANKALGHAARLLVWKTLKPAYNEIVRPALGLPPYPRFAPFQAQFLNHPRLFGFSPTLIEPSASWPEQTRVTGPWYLESRDTWQPSEALMQFLESGPPPIYVGFGSMMHHDAAGFTDTILGAVKMTGKRAVLATGWGGLSEKADFDASTIFALERAPHDWLLPRMALAVHHGGAGTTAAAARAGIPSVVTPVFGDQPFWAARLEHLGVAPRALPREKLTAELLASAILAANAPQMRAAARKLGEELRAEQGVESAIDALRTWGLLPSSITIPQSSSRLKSA

SEQ ID NO: 7739 - protein, 1518 aa, Emmonsia crescens
MPPDDESRTAASSGRSNPHTTSTYRLSSSHIPDRLRMGDDEQEDMTAPPGATTGRGGRFQYMHQSVFSMIAAASSKNDFHNRFDESSDAEDEGADTDADRPPKNRFLSTDGVDGRRRDGSASTSNLPHVAKRDKTSIPRTAEERGRSHHRKKLSEHKFLKSLAILPRRSSRGKELASELEPEIEATVTDKLSSANAVQLVATTEAPVLSRMLDAQSRFGEYEPPPSPTEHSGEDHHERKESSPATLLSARLMDIFGFDRPEKVISEYQCWLLQSVLLQGYMYITERHISFYAYLPKKSHTIIKSGYLSKRGRQNPKYSRYWFALKGDVLSYYLDPSNLYFPSGHVDLRYGISSNLAEQKGKDKDKDVRDFTITTNTRVYQFRADSATSAREWVKTLQKVIFRSHNDGDSVKISLPIENVIDIEENPVIDFADTFKIRVVESGDSYAIDEYFFSFFECGREAIEVLKKMVSDTPAQQIQQAMLAAPDGGYTPRRRRSHSANAISPPSTRGTTLLSEAVKATLRPPSPHGSRSGSPKQSLDLPRSNFRRFGRNREGHSHESSGAGLEQRRRSDSTNRASVEDNQAEKSPRGKLQSSSDSFVQSLEHATESSAILQSTSGTAESASQILNRSDVFQSPTIHRLQDSLSRFGEAPRRHSDDTARIVPSPAEVHIHPPSRTQTTQSLMKSRPAEHQDGGSDSEHDLHHRSVAHSASSPTLQELMKAGSYPLQRAAGFAGYLKSRSKRMSNLLATESMGYFEKVSGMWIGGKRHYGEGEAILSDDRMIDPEDEEQGCEHGDRFRAHFALPPSEKLQATYFAYLHRVIPLYGKLYISNRKFCFRSLLPGTRTKMILPLRDIENVEKEKGFRFGYHGLVVIISGHEELFFEFNTADGRDDCAVTLHQNLESIRYLVESGLLAQQDREEAEAAMAEHQMLQEARLEGMDEQSSQTLSTSMPLSPTNSPILFDDPRVSIVNFKPQEALRITCLTIGSRGDVQPYIALCKGLIAEGHIPKIATHREFEPWIRKHGIDFAPVEGDPAELMRICVENGMFTYSFLKEASSKFRGWIDDLLSSAWASCQNSDILIESPSAMAGIHIAEALGIPYFRAFTMPWTRTRAYPHAFAVPDHKMGGAYNYITYVMFDNVFWKAIAGQVNRWRKRELGLRSTNLDKMQPNKVPFLYNFSPLVVPPPLDFCDWIRVTGYWFLDEGGDWQPPVELENFIKQARTDNKKIVYIGFGSIVVSDPAALTKTVVDSVLRADVRCILSKGWSDRLGDPSSAKVEIPLPPEIHQIKSAPHDWLFSHIDAAVHHGGAGTTGASLRAGIPTIIKPFFGDQFFFGSRVEDLGVGICMKRLNVSVFSRALWEATHSERIIVKAKALGEQIRKEDGVATAIQALYRDLEYAKTLVRQRSHASSASQTGIVAVPMEESGVGISELGLDDDDDGDNDGDGENDGEGDGDGDAAMEDSWTFVGDEAETDLARKTRARERDYDIRVDDMAAAAAAARAIGSNGSHGGGHRDGERR

SEQ ID NO: 7740 - protein, 427 aa, Salinispora arenicola
MRVLVVTVGSRGDVQPYVALGKGLQAAGHHVTLATCARFRTVVTDQGLAYGQLSDDILQLLDSTAGRAAMEDATGVFGSIKTNIKLARQANPINRKLLVDVWAAAQQAEPDVIVYHPKALAGPHVAEKLGVPVVLALPVPVSVPTGDFPLVGLPALPLGRWYNRLTYRLAGAGYRMYDGMVNAFRRETLGLARTSGAALTTRLPDGRPIPVLHGISEHVLPRPADWPAHVHLTGYWFLDGADRWQPPPALVDFIEAGDPPVYVGFGSMAGRDPHRLTRVVGEALRLAGVRGIITTGWGGLEMVEQSDTNWHLTQAPHDWLFPRVSAVVHHGGAGTTAAALRAGKPSVICPFILDQFVWGRQVFALGAGSAPIPQRKLTAQRLAAAIREVTTNADVQGAAARLGRSLAAEDGVANAVARIDAVLDRAG

SEQ ID NO: 7741 - protein, 1525 aa, Millerozyma farinosa
MTFYSKFMSSVVPPFSFLNSRTRSSDNIKDDINSDKKTAAGFTGSDTPGEEVDIAETVGEDPSIGNCVNLLTASQMVEGIENLKWDDERNDRIDDPKFNEATKLSQIAAQEEKNHETKRRGSLENGDKPKQGPNKIEYDLYESEEEDSSDDENSDSRAQAHEGSSTAPDTAQATGIGFNEVQGPSKLSLDKPSNRTPFQQSVLENLNPYLFNESYLMKLSGHSNTHPVTVKDFYDSKRDVICLSIAERLKLVFNLDDDDYFRGNYNVWLVREVLLQGHIYLTKKCVLFFSFLPRTFEDQTKRSFKDEYRHDDSYKLIQEGSLGKKTANYYDAVFTSVITHRFWAILRPETLSLYNSATDLYFPVLVIDLKNCVNAELMEKEYTKRNTSGIATQESEERMVFDEKNISSMLDNEGNANYSEDAVEDYNTGTWFKVLTKKKTYKFYADSLYTARQWVNNITKLIFQFHNSNANNEVLMKIPIESIDYIRKQNLLDNSLQNNSTETDPLLFALNHKAEDQQSNHNLSTSNTKQKVNNSFRNKNGGASLSSNLSVFLFFKDGDSFYDQFLNWTLFKKGSESTLQYASSEDVVSKACSSSSDHSKSFSTLNQLNTNNNIINQILNIKQMKNDSHPPSHLGQKNTPVNSSNSSLASESTHGSVIKDIGKTFTSSAKLLTRKRSYSVPALLNKLTPEKKQLPTLDSEEHIPIVISSEKLKGLDMSLVASEKVLDNLDKRYERFKKNEDPEDSIVFEKIRHPKSVTLSPDLDLDGISHSSPLYLSDPKELHVAKENKKKNKLASFGRSIWAMSCKFTAINHFEEFFVDDPYYVSDLAAKEVSARHFRQHFSFNNEENLVATYYSHLQRSVPVFGKVYIGENEVCFRSLTPGVSTKMILPLQDIEFCHNEKGLNLAYSGLVLVLKGYEEIFMEFYSQKARDDCEVIIGKLMSKCNPLKRFSKSPSNDLSNVKNKEKYISAKEMTRRKYTLALSRRKIENARLKLFEDRLNEAAGLDIPLLLEESPFYKTEIKLSTSFNFVLLTIGSRGDVQPYVALAKGLMKEGHHVTIATHSEFQTWVEGYGISFKSVAGDPTELMSLMVKHSTLSVSFFKEASSRFRRWINELLITSWEACQGADILIESPSAMGGIHIAEALGIPYMRAFTMPWTRTRAYPHAFIVPDQKKGGSYNYLTHVMFENVFWRGISGQINKWRVNDLGLPRTNLYKLAQYKVPFLYNISPTVFPPSVDFPDWVKVNGYWFLEDGNSYDAPSELLEFIKNARNNGKKIVYVGFGSIVVKNAQQLTKAIAEAVLNADVRCILNRGWSDRLKKEDESEVELPKEIYDAGTIPHEWLFPRIDAAVHHGGSGTTGATLKAGVPAIIKPFFGDQFFYASRVEDLGVGIVLRKLNEKSFTKALLTVTTDSVIMEKSKKVGEKIRSENGVADAIAGIYSMLEYARTIVISKQQANESSRSGLSSGLQTPHENESDNYLDTEHNSESEEDNSDTLGDNPSVKSLESLLITDSHPQNDDEVDLAR

SEQ ID NO: 7742 - protein, 999 aa, Cyberlindnera jadinii
METLPSRLSRYWAVLKNHTLTFYPKSTDLYFPSLTIDLRNAIKAQIIPDSKAPPDAAEKDTSWFKVITETRTYKFQADSPNNARSWVGRLKKQIFTIRNNGDCVTVKIPLQNIIDAEETPIFEPAETIRLHVLESGQSFAYDDYFFMFFKSGPEAFKAITHAADEVKQTEEGATPALLSDSTVKFDVQQKTRSFNPLKHVFRSHNGEFSAPGSPASRSLQNVAEVPNSPSMPILSRSTSSFTNEQTVAQIIPASQQDDDNIEEIPDDILSDDEPDESISDDVASASSKNHRFNPLRPVNHARNTISRWTPQFIKSASSMWNANIVHYAEKNSLERGSEDDEFLATNAETVRMTKRFQNHFSLADSDHLIATYYCYLHRNIPMYGKVYLGEKEICYRGLVPGFHTKMILPYSDIENCYKEKGFKFGYFGLVVVIQGHEELFLEFSSSSARDDCEYLLLKQLESSPSDSSSQAEQGESQLSSSKKLEASKIKFIEDKIHSEAGLHIPIIIEDHPLVTTKLKPTKSHKITLMTIGSRGDVQPYIALGLGLKAEGHEVTIATHAEFGDWIKKHGLRFVEIAGNPTELMSLMVTHGSMNVGFMREASSKFRGWITELLKTSWEACQGTELLIESPSAMAGVHIAEALGIPYMRAFTMPWTRTRAYPHAFIVPDEKRGGSYNYLTHVLFENVFWRGISGQINKWRQETLKLPKTNLDLLEQNKIPFMYNVSPTVLPPPVDFNDWVKVTGYWFLDEAVTYDPPKALLDFMQKARDDGKKLVYIGFGSIVVSNPKELTQSVVDAVVKADVRCILNKGWSERLGGSSSVEVDLPDEIYNSGSLPHDWLFPQIDAAVHHGGSGTTGATLRAGLPTIIKPFFGDQFFYANRVEDIGAGIGLRKLNVKTLSKALKDATTDQRMISKAKAIGERIRKENGVQDAINVIYRDVEYAKALIMKKRESWPTNNATVEHKDSAEEEMETEKLLSRMMTASASSDSALSGNASWLVL

SEQ ID NO: 7743 - protein, 422 aa, Bacillus subtilis
MKINLLTIGTRGDVQPIIALGKELSRRGHHVTICTEGSFKDLAEKNKLSFSPIRTDYTHLTQSEEGKSMLKGNPLSIVSQMKTVIYPMMEQMLDDIWTASIDADAIIYHPKVFGGYDIAEALHIPAFIAHPVPIIAPTRHFTNPVFPFAMQSGTLNRASFKINRLLTAAFFPLINKWRHETLSLPDKRSVFKDDSVLNGKHIPVLYGCSPSIIPFDQQWKGHVSMQGFWFLAEDDWTPPPELLHFLEAGPPPFTVSFSSMPLRNPDHTLNMLQQAFKETGQRAILLTGWSGIKQTTDSPHIYTAGSIPHGWIFPRSRAVIHHGGAGTTAAALKAGKPMVICPFSGDQPFWARKMRDIGVAAAPLKERDMTVAAFVSRINELISNNTYFQRASEAASLIDKEDGVRHTADFIEEKLEEKNPAK

SEQ ID NO: 7744 - protein, 1209 aa, Kluyveromyces lactis
MPKDSSEHQKSPSRFTRSMFVDPRAFVRRSVSPVDQLCHSVADLRFVSSNTETLESRLQALSKKFDNGSENHGQDTDTVEDVAKTQYMAKSFAGLIATASMYVGINELGDKEENDEDELELMNDAASVLDTSSQANQTLFEVSIEMNADAISQISTDSKSRKELIRERLIKKFLPNDDEKYIEEYPCWLLRDIMIQGHAYLTNKHLFFFAFIPNFESDFNVTGSLRLISGHVLSKSHRYWVVLKGHTLSFHNSSTDLYFPLLTIDLRDISSVQMTSSENNPTKFELSIKDQSLVLKADSFHSARHWVSSIKKQMFASQHSDTNTMTIKIPLQNIVDLEETSILDKSGTLRIKALENLSTYAVDEYFFVFFKGNANAMKQKVNSLLKDLEMNGSQILVNFNKVDSPLGINEKLPDLNYDDPSNENNLVDDADINSAETDTLSPGTMQSALTLQQTSSAFSPRHSAYPRKVKKKLKSMAGSLKLGSPSKFTKLEDDIIIEHYSPGLINDQTIDYDKDSKSIISRLTPKKFQNVPLMWAADPVHFNSDDGIVFPLDDKYTADADISNQSNVRFRQHFSFDETANLVASYHGYLNRNVPIYGKIYISDKNICFRSLLPGVSTKMVLPLEDVENCYKETRFRFGYFGLVIVIHGHEELFLEFGNKNARDDCEFVMIKVMDAVSSHRSTLKRKSTAEVVHRLSEAASLKLLEEKISEQGFDIPLIVEKNPYFTTVIKPSKSYKFGLLTIGSRGDVQPYIALAKGLQAEGHEVIILTHGEFKDWIVSHNIGFREISGNPAELISLMVQHGSMNMGLLRDASTNFSTWISSLLDTAWEGCQGIDILIESPSAMAGIHIAEALRIPYFRAFTMPWTRTRAYPHAFIVPDQKRGGNYNYFTHVLFENIFWKGISGKVNEWRETKLKLPKTNLVSMQQNRVPFLYNVSPIVFPPSVDFNEWIKVTGYWFLDEKRSYKPPAEFMEFLNKARELKKKVVYIGFGSIVVNDPEKMTDTIIEAVRDAGVYCVLNKGWSNRFGDPLAKKIDKELPSYIYNSGDVPHDWLFTKIDATVHHGGSGTTGASLRAGLPTIIKPFFGDQFFYASRVEDIGAGVALKKLNRSSLAKALKEVTTNTRIIQKARQIGESISKEHGVATAIGAIYSELGYARSLIKTKNPVDDKEMEAASTKLSNDAVVTAKGNEKEEYSSEGSGSNDGSWLLI

SEQ ID NO: 7745 - protein, 625 aa, Coccidioides posadasii
MDNASVFYRILTSISLLPTNQRSMSNTFWRLCELLAQQEKEDADNGGSEAYENEPDDSLFPELTRALDGSASSSNNYDLEPSEASNLSPPEAAPIHFDDPCASIVNFKPSESLRITCLTIGSRGDVQPYIALCKGLLAEGHKPRIATHREFEPWVRQHGIDFAPVEGDPAELMRICVENGMFTYSFLKEASLKFRGWIDDLLSSAWSSCQGSDILIESPSAMAGIHIAEALRIPYFRAFTMPWTRTRAYPHAFAVPDHKMGGAYNYMTYVMFDNVFWKAIAGQVNRWRKRQLGLRGTNLDKMQPNKVPFLYNFSPSVVPPPMDYGDWIRVTGYWFLDEGSSWSPPEQLTAFIQKARNDRKRIVYIGFGSIVVSDPTALTKTVIESVLKADVRCVLSKGWSDRLGDPSSAKTEVPLPPEIYQITAAPHDWLFSQVDAVAHHGGAGTTGASLRAGVPTIIKPFFGDQFFFGTRVEDLGVGISLKKLNVNVFSRALWEATNSERMIVKAKLLGEKIRKENGVEKAIQALYRDLEYAKTLVRRRSIAAASPPLPVPLGSPKARHDWEDDLAGIEDTWTLVGHPDIDMELSQSSKGRESEFDLRASAALATGTLPDIVVDEDDGEEDVTR

SEQ ID NO: 7746 - protein, 573 aa, Heterobasidion irregulare
MTNSLPAVMFTSTSSTFLTFKPKNPLRFTFLTIGSRGDVQPYIALAKGLMADGHHVKIATHGEFQSWVESYGIEFGYVGGDPTELMRICVENGTFTVSFLREGMQKFRGWIDDLLKTAWDACQDTDVLVESPSAMAGYHIAEALRIPYFKAFTMTWSRTRAYPHAFAVPERKMGGSYNYMTYVMFDQVFWRGTAGQINRWRRNTLGLPSTSLDKMEPHKIPFLYNFSPIVVPPPLDWPEWIRVTGYWFLDDASVGAKKWTPPPDLVEFIDSAHSQGKKVVYIGFGSIVVSDPKAMTRCIVDSIVQGGVHAILSKGWSDRLTKNVAEVPEAEEPLPKSIYPLASVPHDWLFKRIDAACHHGGAGTTGASLRAGIPTIIRPFFGDQFFWADRVEALGVGTGVRKLTVDSMAEALIAATTDHKQIDRAKLVGEQIRSENGVAIAIEAIYRDLEYARSLIRRTVHEDAVDAEDSTIREHDQSLSSLSSRPETRSEESSGNGAPSESGGGAPSEDWSVISDQDNTRSSTSSSRHNEGKDRTLSPKRSSLTAAVLSVLPDALTTSGHRRSRSASSVSTG

SEQ ID NO: 7747 - protein, 782 aa, Glarea lozoyensis
MDIEDSQIVDFADTCKIRVIDNDETFAIDESDQNASGPSLQNLVKAGAYPLQRAAGFAGYLNRHSKRMSTLLATESMGYVEKVSGMWKGGKKHYDEPEGLIADGEPHVEGNDEQAAISGDRFRDHFALPETEKLQAAYFGYLHRVLPLYGKIYISDRSFCFRSLLPGTRTKLILPLKDIENVDKEKGFRFGYSGLVVVIRGHEEIFFEFSQPDIRDDCAITLLQNLEGMKFLQESGLLSMEEKESAQNASAEHKALQKARLEENPSHELKLPQSAEESKSEAPPIMFDDPRASILNFKPTESLRITCLTIGSRGDVQPYIALCKGLMAEGHKPKIATHIEFKDWVESHGIAFEPVAGDPAELMRICVEYGMFTYSFLREASSKFRGWIDGLLSTSWKACQGSDVLIESPSAMAGIHIAEALEIPYFRAFTMPWTRTRAYPHAFAVPEYKLGGSYNYMTYVMFDNVFWKSIAGQVNRWRKNELGLQSTSLEKMQPNKVPFLYNFSPSVVPPPLDFSDWIRVTGYWFLDEGGQDFQPDKDLMDFIAKARSDGKKLVYIGFGSIVVQDSAALTRTVVDSVVKADVRCILSKGWSDRLEKKDANKIEVKLPVEIYPIKQVPHDWLFSQIDAAVHHGGAGTTGASLRAGIPTIIRPFFGDQYFFGSRVEDMGVGIAVKKINPEYWAQENGVNTAIQSIYRDMEYAKSLIKSRKGKPSDDNIEDSEESWTFIGDENDPELVKRIHNWDSVAQLGTLNRKNEGLAGSDESGNSIESRFNQKASLQADTG

SEQ ID NO: 7748 - protein, 409 aa, Kribbella soli
MRFVLATWGSRGDVEPLAGLAVALQELGAEATVCAPPDDDFEALLARAGVPMAPLGPSVKSVVAAPKPPSGQAAFELAPRLVAARFQTLGAVVQDADAIVATGLMPAGARDVADKLGIRYVLACFHLGGIPSQHFSPGARPGTPSPEGETDRRVLWQHDAERVNALYGPSLNSHRAEIGLPPVESVRDYVLTEHPWLAADPILCPSKGMTDLDVVQTGAWLLPDDRPLHDELEAFLGAGEPPVYVGFGSMAAYAPKDIARTAIDACRAHGRRVLLSRGWAGLDLADEGRDCFMVGEINQQALFPRVAAIVHHGGAGTTTAAARSGTPQVVVPLIADQPYWASRVAALGIGAAHERATPTVDSLAAALGIALSSETQAQAAKTGGEITTDGARVAAGLLVDGAMEGVKKV

SEQ ID NO: 7749 - protein, 1647 aa, Stemphylium lycopersici
MTRPRPDSTQAPIPVAYEYDDDRHDEEAPPPYTAEELTGSIPQPGDTKATNDGRIEIDLNSRLTKTLIKLVPKHDKEEPELSRRYTVTNLWAIRLNIVIQVVGSRGDVQPFIALGQELQRHGHRVRIATHNTFESFVRESNLEFYPIGGDPKELMAYMVKNPGLIPSMKSLREGDIQSKREMITEMLYGCWRSCVEPDLQSRQPFVADAIIANPPSFAHVHCAQALGIPLHLMFTMPWSSTRAFPHPLANFKVGVISPALINYASYGIVEFLTWQGLGDVINDFRRTLDLEAVPISVGPVLASALKVPFTYCWSPALVPKPPDWPSHIDVCGFFFREPTPYTPLDEIDRFLRNGLPPVYIGFGSIVLENPAKMAANILEAVQRLGVRAIISRGWSNLGSDLPNDNKDVLFIGDCPHEWLFQHVAAVVHHGGAGTAACGLRNACPTLVVPFFGDQPFWGEMIAAAGAGPQPIPHKLLTTENLTQAIHFCLTREAKHAARGLSAQMASESGVEAAVQSFHANLPMDTMRCALIPTMAASWKTKKDSIRLSKIAAQILIENGILVPSDLENHETYPIFITNPRWDPVTSTTSACVGIVGDMGIAAKSMVIDPFTGPKPEIASSSSSTSSKKQSGGAAAGRVAVDVSKGFGKFVGAYFKGVIVDLPLATTEGFRNVPKLYGEEVKDHGNVTGALSGFQVGGKNFVQGMADGLSDPFRQTYEGGKKEGGIGYAKGFGKGVAGLLTKTSAATLGIVAYPGDGIVKSLKYLAKSGTRKRIRASKLVESEWLGGKTEAEFNVRELIQEFERLKKGVCERCHRLRKECTASSSIRKSNANTIPASKRSRLEEKLDEVASLLRAQRVPTSQPSSDNLSILTPDSTTQWRNDVNSALSESLTNPQLADLRANYLKYFPFMYLSEDTTAGDLQLHKPILCLAIRTACTKAITRQSEMAKALREMLATKILVEGERSIDLLLAVIMCIACLARSLVTDLRLDRPANPSGCPSLGPHLESWGARSNEGSRALLAVFALSTNVSTSFKYDIVPWSTQHEEACNSLSQSQESDADAILIAAARLLKIASTATDVHRRALDDPSMVSHAMVAIEPMKLALNSFMATLSPEQLQHSAIIGFTHTAQVAIYELAFLQSLPSSATVAPVQHYDFDARRIRTELGDPWSSARLSRVSRLSSTRSMTLGGTLVHTRSPPHSLRFRATLQPLSGKLYMHFNNKAVFLLFVLLFEIGSLVCGTANSSAMFIAGRAIAGLGASGISNGAMTIISGAVPREKAPSFYMNLPIGGATALLLLIIQIPEITEKAPLSMTLVRTVIPQLDLVGFTLFVPASTMLLLAFQLGSGDTYSWDSPTVIGLLCGACVSAIVFVFWEYKMGDKAMLPGTLLGKRIVWTSCFYGSCTMICMLTASNWLPTYFQAVKGDDPADSGVHTLPGIFSQLLLIIATGAAVSRTGYYLPWGLAGAIVITIGNGLVSTFTASTSTAKWIGYQIVLGAGRGIAMQIAIIATQNAVLPAQYPIALACLIFFQNLGTSIAIVIANTIFSQTLTSVIPRYAPSVSPQAALDAGSGADAVRSLIPAVSKNELAGVLRAYSESLRDVFYFLVGVAALAAFVSLGMGWKDVRSKKHEETIDKAPDEKLGENKAAENA

SEQ ID NO: 7750 - protein, 1244 aa, Escovopsis weberi
MEFPEPLRYSDDERRAEALLSDGPPMAVNMNQSIFGLIAAAGSRVDFNDRFDGSSSDDDGGDDDDDDNDKNIDDDDDGGGGGGGGGTPRSESARRQRHKLSQTALFHHPLKDKRRSHNPRLSGHRLLKSFASLPTRRSKPGRETSKLSEPTEEVEEPQQPDDSPSPDAIDQAELQEELRLAPVMGRMLEAKAEIANRPSSDLERPSSASASASALPHQPEEDDSASPLAKRLKEIFEFDKPERHAVAKSGFLSKSGKRTSKYSRYWFRLKGDVLSYYPDSTNLYFPNGQIDLRFGISADITDRDKEGVHFSLVTSHRTYNFRADSAPSAKEWVKSLQRVIFRSHNDGDSVKISLPINNIIDVEDSQMMEFSDTCKIRVIDNDETYAIDEYFFSFFSFGKEAIDLIKSMVENASAEGPTAAREIAAFEERASDASSQGLAPYQARSDTSERPFDRIRTLKPLDTRAQTTGHSEALGYQRQTDTPTPSTPTLQSITKMGAYPLQRAGAFADYLNKTSKRMSTLFATESMGYVEKVSGMWKGGQKHYGEPSGFRPDGDGAEEDGQDGAEVSMERFRAHFALPDTERLQATYFGYIVRVLPLYGKIYISNKYFCFRSLLPGTSTKLILPLKDIENGQKEKGFRFGYSGLVVVIRGHEELFFEFRTAEIRDDCTVTLLQSLESNRVLQDSDVPDAEDEDNIISERLARKMAKGEELAPRQVQLIQRAPGRPDSPTPLVDDTDASSINIRPPQAMNITCLTIGSRGDVQPYIALCKQLLKDGHRAKIATHAEFQGWIESHGIEFACVEGDPGELMRLCIENGTFTISFLREASATFRGWLDELLDSAYRACQGSDLLIESPSAMAGIHIAEKLGIPYFRAFTMPWTRTRAYPHAFIIPEHKMGGAYNYMTYVMFDNIFWKATAHQINRWRNKTLGLPNTNLEKMQPNKVPFLYNFSPSVVAPPLDFSDWIRVTGYWFLDEGRDYEPPRDLKDFIQKARDDGKKIVYVGFGSIIVPDPAKMTQEVIDAVIKADVRCILSKGWSDRITSKNEPRRVSIEEPEMPPEIHVIKSAPHDWLFRQIDAAAHHGGSGTTGASLRAGVPTIIRPFFGDQFFSASRLEDLGVGVWVKQWGTNSFGRALWEATRNERMIARARLLGERIRKASVEIAVQSIYRDMEYAKALIKAKSGQSETEDDDDTEESWTFVRGDEPDPDMVTPKLSEGLEGLGLGSGAIKANDLKGKDGRPVMRADD

SEQ ID NO: 7751 - protein, 1421 aa, Nectria haematococca
MAPQSDAAPVRASVGDDHVKKRVSRKLHKRRREDLSATIFPEPLQESDNSGDEDVVPTQGPPMFMNMNQSIFGLIAAAGSRVDFNDRFDGISSDDEESPEPKDREGRSEDMSKTSVLKSAGKEKGHRRRKLSEHKLLRSLPALPKFHTKSKRHSSRLSAPAEVADESSDASQSGLSTPPTFAITRHDSHGRQAPVMSRMLEAKAEMTSRPSFDLDRLSSDASRSSDSQEPQPLAKKLMEIFEFSEPERVIEEYPCWLLQSVLLQGYMYITSKHICFYAYLPKKAHEAAKSGYLSKSGKRNPKYNRYWFRLKGDVLTYYASSTDLYFPHGQIDLRYGISATIVDKDKEGLHFQVETHHRTYHFRADSAPSAKEWVKSLQRVIFRSHNDGDSVKISLPIENVIDIEDTQMIEFADTCKIRIIDNDETYAIDEYFFSFFSFGKEAINVLKILIEDTSPANRSAEQIPPSARTSMAANRNSLHVGKLRTTKLPDTVKATLSPMSPSSPSQLSPRASMDAPRSSFDALKNFGRKSIDVSRPPIRDISPRTSFNGTRRSMSRRRREGTTTPKQALDSGDSFLQSSVEDPSISTLAPSSLEDPSASQILRGSEVFHNPTMRRSASASRKVSPDKNVPRNSSAPRIRPIVHAATTGSMQEMQGEGESSQRPLTPTLQSITKMGAYPLQRANAFAEYLSRTSQRMGSMFATESMGYVEKVHGMWKGGHRHYDEPSGLRPDDDDDEEEDGKIQNLMDRFRAHFALPESEKLLATYFGYIVRVLPLYGKFYISDRSFCFRSLVPGTRTKLILPLKDIENVHKEKGFRFGFYGLVVVIRGHEELFFEFRPPEIRDDCAVTMHQILETSRYLEKSGILEQEEQEDEDVAIAERDALKEARQDEFADHELQLPHETSGVSNAPTILFDDPNASALAFKPQKSMKVTCLTIGSRGDVQPYIALCKGLLAEGHKPRIATHAEFQGWIESHGIEFARVEGDPAELMRLCIENGTFTWSFLREANSTFRGWLDDLLDSAFKACEGSELLIESPSAMAGIHIAEKLGIPYFRAFTMPWTRTRAYPHAFIMPEHKMGGAYNYMTYIMFDNIFWKATAYQVNRWRNNTLGLPNTSLEKMQPNKVPFLYNFSPSVVAPPLDFSDWIRVTGYWFLDEGGEWEPPQELQDFITKARADGKKLVYVGFGSIIVNDPAKMTQEVIDAVHKADVRCILSKGWSDRISSKEDPNKPRAPEPEMPPEIHVIKSAPHDWLFRQIDAAAHHGGSGTTGASLRAGIPTIIRPFFGDQFFFASRVEDLGVGVWVKKWGTNSFGRALWEVTRNERMIVKARVLGEQIRSEAGVENAIQCIYRDLEYAKSLIKRKAGKNEQPDSGEDDDTEESWTFVGRDEPDPDVVTKKLSEGLAGLGTGSERSLGSQVQSSVAT

SEQ ID NO: 7752 - protein, 1243 aa, Starmerella bombicola
MQETLSSQQPDAQPQRISNSEEQQYDDSAFNSDADDEDGLEKIQRFFTGESSAYYGQDDEDLNAREREYVTQLLSEEGEAGLSVGRFEGWLGKTVLLQGKIFITNRYFLFYAHLPVTNGTLKASPLAKKSVRHLVGIGKASYIRFWFVLRAGALLWYEDPGDIFFPAGLLSLNLMSEIRVVPEAPEKFCIKSLTGKVYTFKADSRNAANEWVKAIEKEIFKARNNNTAPSVVVRIPLKNMISLKTLKPLDFVDVIEFLAITQGSVNPAESQVGKFTFAFFGDQKTLNSIIDRISTSTNNFEHQKGVKFNTTAEGEELDLAHSQVGPVDESVFDTTRASNTDVFEFKYVSDDREAVRLAGEDETESGSQVSSQLTSEHSSSLNLSPISSHGNRRSFFSKSSLRSSTLLHSRIPTRSGTPSKSPTPTDSYSHSKSKTNLFSTLNEKLHKLKHDDSKIDLAPIIAMPKKLIPNLGEQSHDVSDTEEGADSDDDEESQDDSKINLNLPQVLSQKLSIFSSDPSTDTSMASEAQSSQLDLNSLNQKFRERFGLPSFVNLLAEYQRSFKKPNDSSSWSGTLLVASDYLCFNRQKSGSSCHRMIIPLKDIIHIKKEPMQSSNLEFEVAETAYSEFSLKFPEPADRKDADDMTRSVWQQQRTKDEGNTLRGNSNNHDTIDSEAQFLEYSLRSARLSTYEPTVTSQLKRRIPPLMFDPTSTQYKEIFLQKPMKTLTFAMMMIGSRGDVQPYLALCQGLMEEGHKCIILTHGEFKETVEGYGIEFREIAGDPRELMELMISHGSISYSFIREVLSHFKSWLKELMKTAWKAMKDSGADVFIESPSSMIGIHIAEALNIAYYRAFTMPWTKTKAYPQALLAPDQKRAGNYNAFTYVMYDRLVWFGISKYVNKWRKHMGLPETDLDTLHQEDVPFLYCVSPTVLVPPLDQPDWVHTCGYWELRPNEDKKESGDAKVAAFIKKAREDKVPVGYIGFGSIIVSDPEAMTQTIIDAVDQSGVRCVVARGWSSRSTKKKDNDDESDSTEKKPLNHENICDVDSVDHQWLFPQMDVCVHHGGSGTTGASLRAGKPTIIKPFFGDQFFYGRRVEDLGVGRNLKKLSTKGLAEALKECTTNKQMIRQADVLGEQIRHEHGVEEAILCIYRELAYAKDVTIRRRNATLEASKNGLFSDPLGLLNPAELFSHKDRSEAEILEKEDGGAAKNKDKDHLWFTLPKFGRREEQRQNRDADDEIDVSV

SEQ ID NO: 7753 - protein, 431 aa, Chondromyces apiculatus
MKITLLALGSRGDVQPSVALGKGLAARGHTVRVLAGTNFHPWIVKHGLETAPSSLDMQDIMRTEWGVAWAEKGTNPLLASRAVARIHEQFGWALTEDILHACEGAELILSSFTSDFQACSIAEATGALHISVPLQPSALATRHGPSSLAAVVPGKDSVLNQLFAKAMVEPTIWRWTGANVNRLRRERLRLPEHTRSTAFEALRRTPTLHGCSAHIAPRAPDWPADWQVTGYWFLDEAEPYAPPESLTRFLDAGEPPVCIGFGSMPASDPAALTRMFIDAISRSGRRAILLSGWAGLGGVPLPDTFFQIDSAPHDWLFPRVAAVVTHGGAGSVAASLRAGRPTLVVPHMSDQIYWGRRVAELQLGPSPIPRPRLRADRLAEAIALTSDPAIRRNAEAMGAKIRAEDGVTTAVDAIEGIIAARRPEGSSARGR

SEQ ID NO: 7754 - protein, 1239 aa, Melanopsichium pennsylvanicum
MDGARAGDCVRTKAPVKISSEEKMKALIEEFGECPSLSSPNEPEKLIIDLSCVLVKTVLIKGSVFLTNRRICFLAYIPNVDVNASSPSAVNKPASQNHADSSVRAPVDPNVQNPILKSGPAVIHRPGKMRAKRRVWIELRKTSFNAYAASNQLYKPLLSARLSNLHAVLPIDWAHPNIIRFVEGNKYSSVEFKTQEAALDWRNELEAAAFHARNTAEKVRISIPLERVVGMDSAPFLQVVNVIHIDVLVGSVKDADAAKSIKEAKVKAEYRHLVEQNWPTNHTFINCPKNPGFKCQITQVAIGFTHDRAAFIDLLREALKVPRSTHDPLGYQELLRNVPTPLLDFQGDADADEQHSDRHDDSAPDEQNQSLADKFCHAFGLPSRPEELHLVKAELVRTLHTHGTMAIGLNFLLFWRRAVGRDLRIKVPLTDIQGVDSYRSMLWHHHGLVVHIRAHSDMFFDFLNKENRDMVLSTLKGIVKAKEDQAKSPNAESHANRVESLANSTDSAHGTVKKSLFTQALLSNAEAEVPVFEPDVLAYVPKVVNVDRDVARDAIRISPMRIYCLTIGSRGDVQPYIALCKALKKHGHTPVIVSHPEYRGWVEGHDIEYRGVGGDPAALMKLSVEHRIFSPAFFRESIGKFRVWLDELLRECWEECQGADLLIESPSTMAGIHVAEGLGIPYFRAFTMPWTKTNAYPQAFSVPSIEMGPSYNSSSYALFDQIMWVATSGQINRWRKHMVGIGPTDLNKLDADNVPFIYNFSPAVVPMPNDWGDRVKISGYWFLDNPESNWKPPKEMLEFLVKAKDDGKKIAYIGFGSITIENAEEVSANIMKAVRESDVRAIVAKGWSGRGGSSKKKKKQQQLAKLKPALQQHHSSSTTHESEDNATESETEREPEIPSDVFVVDSVPHDWLFPQIDIAMHHGGAGTTGASLRAGLVTLIKPFFGDQFFWANRVAKLGAGARVNGLSVSDLTDALKAAASDRIMVEKAQGVGEKIRTEDGVATAIEFLYKNIPLAKRRTQRHIEREMSHASPAGTPSSSVFTNPLARFSSHSRSNSGSNTPRRDQHRSATLPPTGSSSAALSLGSEIDDGSRVLHKSTSTIVESPSNESSTDFTSSKSDHKSRKSSGSILPSLSSFSVLPSNMVASLKEMTTLQSNTSDTTADGEEARVGEKSATLTPTSSVVTGEEETEEHKLARLKGYKNAKAEDIRRRKLLLEKLERERVEKEEEKERKQRENKEG

SEQ ID NO: 7755 - protein, 885 aa, Fusarium langsethiae
MALNRIKSRGRGHLVIDDYDANNGPTSNVIDDGRVEVQFHDNPQALAVWCQHFKDSFAGDTLSSERLQPPEPRRTNSIAFVPGVEKPAESPRLHIAIQIVGSRGDVQPFIPIAQLLMKPPYDHRVRICTHAAFKEFVEAQGIEFFNIGGDPEALMAYMVKNPGLLPNCDSLKGGEVGKRRKEMAEIISGTWRSCIEAGDGMGEPIKAANVESADDLFLADLIIANPPSMGHIHCAQKLSIPLHMVFTMPWSPTKSFPHPLASMSYGDADAKVANYLSFMMMELLTWQGLGDLINKFRTQTLHLDPVSPLWGFQLLSRLRIPFSYLWSETLIPKPSDWDDHLNITGFSFLPLASSYTPPPELVSFLENGPMPVYIGFGSIVVDDPQALTTMIFEAIKIAGVRAIVSKGWGGVGAGEVPEGVYLIGNCPHDWLFQHVAAVVHHGGAGTTAAGIAAGRPTVIVPFFGDQPFWGQMMARAGAGPVAVPYKGLTAEILAESITFALRPDVITVAKDMALQIGEEDGSGGAAMDIQERLDIDSLRCDLSPGRLASWLHRKTGAHLSGFAVGCLRDHGLIEMSDLKLLRHKHWYVDEGAESPAIGAIAAVSGFAAAIGTATSDYTERLRNSPHPGTARRRSSIGLRKFPTTEDGTMDPRLRSQKGPRDVTQADMEALAQKMASKTLYGAEPAFSAARLCRPVSEAHQDRKNSWRARERGSNGRVFYVTRVTGKYACDLAAATARAPVAFFYNVANGFHNAPSNVFDIDVRRRDEITGLGSGVRTAGKEFCYGIWDAFSGIVMKPYEDTKNLGVKGLGRGLLRGGLGIIGNLGTACFGLPGYTLKGLEKELMKRYMTNLKAEILLIRLRQGIEDWRRGRESEKDEVVRRWKIV

SEQ ID NO: 7756 - protein, 855 aa, Friedmanniomyces endolithicus
MSASQMLTGDTAFREPTLHMPQPRRTFSGSTVERLRRESQRRSPSRTSDEERIHVQPPSLTAAEDPPSSGRGHFIAKKDSKKLHPAAVVPAASRPKRTILATPLQYAYGLADHMRSQGKRGLSYLGSSPKDYYTKFSGAMAGGKRHYSEADGLAPESHIEDPEDDLDTVEHERRFQQHFALPESERLLAVYYCSLHRVLPLYGKAYVGTRNFCFRSLLYGTRTKMVIPFKNILNLEKEKGFRWGYPGMVVVIRGHEELFFDFSSNGLRDDCVVTVLRTLEAVRALQESVILTPHEKKDADAAAAENQLLSGVRKDLHADRDADPSEILSRIESGTPMIFDDPNASILDFKPTKAMRITCLTIGSRGDIQPYIALCKGLLADGQHPRIATHREFQGWVEKHGIEFAPVEGDPAELMRVCVENGMFTPRFLYQATSQFRDWFDGLLTSSYEACKGSDLIIESPSAMAGIHIAEALSIPYFRAFTMPWTRTRAYPHAFAVPSHKQGGAYNYMSYAFFDNLFWQISASQINSWRRKHLGLKPTSLEKLQPNKVPFLYNFSPSVVVPPLDFSDWVRVTGYWFLDEGTAWTPPADLQAFIDKARADKQKLVYIGFGSVTVSDPRELTQHVVDAVLKADVRCILSKGWSDHFDKKDASVPEVPLPPSVFQIRSAPHDWLFKQIDAAVHHGGAGTTGASLRAGVPTIIKPFFGDQYFFATRVEDLGVGIHLRKITVNALGKALWIATHDDRMRGKARLLGEQIRNEDGVTTAITAVYRDLDYARTLIKKREVKIEGGGEVEDTEEAWTFVENDSDGDVARLGEPEVVWPASSSRAQGSWGGGGAYGKRTSLGSMVLRGGQRTG

SEQ ID NO: 7757 - protein, 1327 aa, Drechmeria coniospora
MNQSIFGLIAAAGSKVDFNERFDDGSSEDDDGPEQPRRDLAQTAILKPHTPDAARRHKRLSGHRLLRSLATLPKRIPKPERGAGRPSVPLPLLTLDDRSASTELAEPDENRLAPVMSRMLQARAEMSSRPSFDLERPSSADLSGVDDGDNHMLLARRLKDIFEFDDVEQVVAEYPCWLLQSVLLQGFLYITAKHICFYSYLPKKANVVAKSGYLSKSGRRNPRYNRYWFRLKGDVLSYYRDSTNLYFPHGQIDLSVGISADVVDRGKNGVHFEVVTSHRTYSFKADSAPSAKDWVKSLQRVIFRSHNDGDSVKISLPIDNVIDVEETQMMEFSETCKIRVVDNDETYAIDEYFFSFFKFGEEAVNVLKILVEDASGNEAAEAVAGLSVDGSPRDSKNTSRSNLLTDRARSTKLPETVKATLSPLSTHSGGASPRPSLDVSSRTSFDAVLHLGRRSHDVPSPLREQGPRRSFSGSRSQSLRRRSDRSRPVASSDSNVPSSTDEPGYSNVAVSTTEDPSASQILRGSEVFHSPTMRQSPTSSPCADARPGLPHHCATTGHMEQLAYRASLDPGRSSTPSLQSITKMGSYPLQRAGAFADYLNKTGKRMSSLFAAESMGYVEKVSGMWKGGHKHYDDPHGLRPDDDDLEQDSEGKVQTSMDRFRAHFALPDAERLQATYFGYIVRVLPLYGKIYISDRSFCFRSLLPGTRTKLILPLKDVETAHKEKGFRFGYAGLVVVIRGHEELFFEFGPAEVRDDCAVTLLQSLETNRFLQASGVLRDDEADDEDSAMAERDALSSARQGEYPEHEIEMPSQTHLPNAPTILMDDPDGSFLSFKPAGSMRITCLTIGSRGDVQPYIALCKGLLADGHRPRIATHAEFQGWVESHGIEFRRVEGDPGELMRLCIENGTFTLSFLREANAKFRDWLDDLLDSAYHACEGSELLIESPSAMAGIHIAEKLAIPYFRAFTMPWTRTRAYPHSFIMPEHKMGGAYNYMTYVMFDNIFWRATAQQVNRWRNSTLKLPNTSLEKMQPNKVPFLYNFSPSVVAPPLDYSDWIRVTGYWFLDEGDEYRPPRELEDFIQKARDDGKKLVYVGFGSIIVDDPGKMTQEVIDAVLKADVRCILSKGWSDRISPGDDPEKPRPREPDIPPELFVIKSAPHDWLFRRIDAAAHHGGSGTTGASLRAGIPTIIRPFFGDQFFFASRVEDLGVGVWVRRWGTNSFGRALWEATRNERIIVKARVLGEHIRQETGVADAIQSIYRDLEYAKSLIKRKPGSKPDGEEDDEAEESWTFVGGDEPDPDVVTRRLSEGIVGQSAESKGLGSQVLKGRA

SEQ ID NO: 7758 - protein, 922 aa, Trichoderma virens
MASRTQRSRQKSVVLGEFGKCTGRAQPDGRMSITVHDTAHTGYIANAVGAVKYSMQSRRKMTAADARENAPKLAQIPQKLNIVIMVVGSRGDVQPFLRIGKQLKEDYHHRVRIATHPIFRDIVESQAGLEFFSVGGDPSELMEFMVKNPGLIPTFRTVKAGEIGKRRAAMATMLDGFWRACIHATEDDCTSLQANASAPNAFADKDIFIADAIISNPPSFAHIHCAEALGIPLHLVFTFPYTPTRAFPHPLANIKGNTENAKDGGYANFMSYPLIETMTWQGLGDLINDFRVRTLALDAVSTFWAPYAIYRMHVPFTYLWSPALIPKPNDWGEEINISGFVFLDLASAFDPPQPLVDFLNAGEPPIYIGFGSIVVDNPKSFTKIIFDAVGKAGVRALVSRGWGGLGLDKDQVPDNIFMLDNTPHDWLFPKIKACVHHGGAGTTAIGLKCGLPTMIIPFFGDQYFWGSMVGKSGAGPKPIPYKRLNYENFAEGIGYLLTEEAKSAAEEIAESIRADGDGAKNTMESFQRQLKMYGPPTLSCSIIKSDVAVWKVKGTHIRLSTLAAAMLVDGGHLSWNKLRLLRHSEWSDFGGPGEPITAIAESLKNSVRDVFQGIASAPYRLGRTTKQRLRQRSRKKSKEGNATKPLPNASNEMSGSAATSCTGNPRTRRQSLIPVSHVQYGRDISSSLIETGSALAKAPTLFIVALAQGCHNAPRLYGDDTVRRLHRVTGFHSGLVASRREFVYSIFDGVTGVVTLPIRGTRNEGAVGLLKGMGMGLGGLVLKPLSAIVGPVGYTMQGIMKQIQRRNSPQKFVRLARIAEGQRGVSELHGTEAEMVRRQIVAGWEVLQELHQAVADTDRWAYLTGKASKVEFLFINVDRAKVYLDALKSGKSVDDVMAMYEAWNIKPQDPAMKKTNSSGTRC

SEQ ID NO: 7759 - protein, 792 aa, Botrytis cinerea
MSDRVKNRGGDFENQKLSEDVHINWDQPPPYDAVLHGSSGNISATITDDGRLDVCINAKAASSGILPPILPDNSSSHEALVATYSAHPPLNIVIQIVGSRGDVQPFIALGQELKASGHRIRIATHGNFKDFVESSELEFFSIGGDPAGLMAYMVKNPSIIPTFDTLRSGDIGRKRKMIYTMLNGCWESCIMPDATTGIPFVADAIIANPPSFAHIHCAQALSVPLHLMFTMPWSPTRAFPHPLANIQNGDGDPRTANYLSYGLVDMMTWQGLSDVINLWRKKSLNLEPVPNMAGTGLAEALKIPFTYCWSPALIPKPVDWPSYIDVCGFFFREETPYTPDRELAEFLKSGPMPIYIGFGSIVMEDAAKMTDIILEAIRACGVRAIVSKGWSKLGTNRSDPNVLFIGDCPHEWLFKNVSAVIHHGGAGTTACGLLNGRPTSIIPFFGDQPFWANMVAAVGAGPRPINFKALDSAKLTAAIRMCQEPETGRAAALIATRMKDERGVKEAANSFHRNLPLDAMSCDVLEGQNAVWLWRRKTYQVKLSDRAAYILLKNKKIEAKDLTVQSRPFVIENPRWDPLTATSSALLGTIVDFSAVLWNTVADPYKAFNVAPDSRADKISSTGGAIGHSMVALGGSITKATLVSVPMALADGFHAVPKLYGEKVRDHGPLTDWKSGGVVAGKSFGYGFYDGITGIVTQPMQGAKKDGALGFAKGLAKGTVGLITKPGAAMFGLMAYPAMGLYKSINEMGLSTAQKQVLKGRQMLSAYINEKMPPQEAEIGTVLEQFELKKKR

SEQ ID NO: 7760 - protein, 1382 aa, Acidomyces richmondensis
MAASASSAMQFQSSFKRRLGSKKSANSQRPSVDMPECLRGEEDDDIDATGAFDAMGPAQVQQSLYGFIRAAGGQFGAVFESGIASDSENDTEFEDEGKDIFDSARNPSEATGDLSSLEDQRGNSQLKPLPHRKGKPLAQMLMKPIRESNEVHSDDTMSQSQFLPPRETTRDALELPANSLDVHKQDAAVDRILQPEANMAMENSQTSLVQKRSKEQLCNDSSRDNKKQLSRLPVAVADIFGFDDLEQTVIEYPCWFLQNVLVEGYIYITNKHVCFYAYLPKKRSTAIKSGSLSKQGKRNPRYRRYWFELKGDVLSYFASAADPYFPRGAIDLRYGISAELDQEKGVPTTAFTVTTQSGTYHFKAESAPSAKEWVKQLQKVIFRSRNDGDSVKIVLPVVNIVDAESTGMMGRQDTIRLRVIDNAETYAVDEYFFTFLKHGQAALDTINGLIENNSLREVANPAGRGVSEQGIPDSMAIPSSKGYQSTNEISDWFPGHVPPSASSMRSTVSRQTFGSTGGPKPRSSDEFDRPSEERSRASIGRKCLNTDQGRQIPKLADRGNWYGAQQTSKPTPSSSTEESSESFTSSDHVEAPTGCIQADMSASQILGGDKMFQSPTIRASQHHLSVPPSHQSPDLSIGIQRARDPRSIQVSRRTSLPPLGGMSMRILATPLQQAFNLYDNMRNQSKRGLSYLSGSPKEYYSKFSEAIAGGQKHYSDLNGLPEDRIDDPEQDLDASEHQRRFQEHFALPKSERLLAVFYCWLHRVLPLYGKIYIGEHFFCFRSLIYGTRTKLKVAFKNMLNVEKEKGFRWKFPGMVVALRGREELFFDFTSNGLRDDCVVSVLRCLDNVSLVQSSVLLTEDERKDAQKAAAENERLEMARKDFNSKFNMPSSAKLDGFETESQSILFDDTEASVLDFKPTKPLRITCLTIGSRGDVQPYIALCKGLIADGHKVRIATHHEFGPWVKQYGIDFVPVDGDPAELMRLCVENGMFTPSFIFEVNFKFRGWLDKLLNSSYEACKGSDLLIDSPSTMGGIHIAEALGIPYFRAFTMPWTRTRAYPHAFAVPGHKRGGGYNYMTYMMFDNLFWQITAGQINRWRRKTLGLKPTSLEKLQANKVPFLYNFSPSVVVPPLDFSDWIRITGYWFLDEGEQYVPPADLVAFIDKAHEDKAKLVYIGFGSITVSDSKVLTQQVVGAVRKAGVRCILSKGWSDRLSQNKQDPSALEVPLPSEIFQIKSVPHDWLFRQVDACVHHGGAGTTGASLRAGKPTVIKPFFGDQHFFATRVEDLGVGIRLEGITVNSLGRAIWNATHEMRMREKARALGEQIRREDGVGTAIKAIYRDLEYAKTLIKRRDLYTADEDADTENAEEWVYVENNVDIDLTST

SEQ ID NO: 7761 - protein, 410 aa, Sorangium cellulosum
MKTTVLAVGTRGDVQPAIALGKALAARGHDVRVLAGKSFQAWIEAHGLTAIPASVDTVDIMESDLGKAWVARGTDPLAQPRILQQIIDRYGAEMSEDALRACEGAELILSSFTSDTYAASIAEASGAVQVSMPLQPSILATRHGPTATVAPVPRGDSALNLLVGKLLIEPTVWRWYAGVTNRVRERLGLPPQGRRAYLATLRRTLVVHGYSAHVVPRAPDWPPGFHTTGYWFLDEGGAYRPPEALERFLAAGEPPVAVGFGSMTSHDPAATTRLLVDAVVRSGRRAVLLAGWAGLGDAALPDSILRIDAVPHDWLYPRVAAAVIHGGAGTVASCLRAGRPAVVVPHLGDQLYWGRRVEELGVGPRAMPRPRLTAEALAAAIHAAATDAGMRQRAEELGRKIRGEDGVATA

SEQ ID NO: 7762 - protein, 524 aa, Citrus unshiu
MAEPPVKSRSSSSSSSSEVSIKLEREIEGDSIRDRPSVPSIPRTNSYPVEVLSSKKLEPQTSSQLRLERAKTETHRPRAILAKHAAQIFDNKIPVQQKLQLLNRIATVKDDGTVEFEVPGDIGPHDLGAASQDVYTEVAHDEPLDATDLQYIPPLQIVMLIVGTRGDVQPFVAIGKHMVKNKGFLPSGPSEIPVQRNQMKEIIYSLLPACRDPDLDSGIAFKADAIIANPPAYGHVHVAEALKIPIHIFFTMPWTPTSEFAHPLSRVKQPAGYRLSYQIVDSLIWLGIRDMINDVRKKKLKLRPVTYLSGSQGFDSDVPHGYIWSPHLVPKPKDWGPKVDVVGFCFLDLASNYEPPESLVKWLEAGSKPIYIGFGSLPVQEPEKMTQIIVEAFEQTGQRGIINKGWGGLGNLAEPKDSIYLLDNIPHDWLFLQCKAVVHHGGAGTTAAGLRAACPTTIVPFFGDQPFWGERVHARGVGPPPIPVDEFSLPKLINAINFMLDPKVKERAVELAEAMEKEDGGFLS

SEQ ID NO: 7763 - protein, 1270 aa, Lachancea quebecensis
MPGRKPDIDEATNEARQRSSAIVESPKRRWRRSMPPVGRMYQSFTSFASPNRNSSDGGSNNPTFSDEDSPDVQTGEEKDQEHDLAIPCGMAKSIVGLLTTASVYAGMGDIEQAESICEDEDSDASDGSEGTNRSEALERSESCEDSEAPKVDKTDLEDVSESSRHSITANGADDDAGADDSTTISETPSQISKKDTLFEISVVPNSDLQSVVTSSSKSRQSKIYRKLISKFGLNEEEDQFVLTCPCWLLKDLLIQGHIVLTTRHLLFFAFLPKSTGATKMSGNLATVSGRLRGRWTRHWAVLKDHTLSFYNSPKDLYFPILTIDLRYATKVELSKHDGEATGDFRIFTEGKTFKFRADSNYAARSWCSALKKQVFATQNSENDSLSVKIPLANIIDMDEQLVVAQSVTLRIRVLESSQSFAVDDYFFMFLNKKDLKLKETINTLLLELDRVSPEELGNAAIANETAESALVDESTQKDSHPGRRGRSSSTSKKLFKRVLSPMSRSPGHSLSMSISIPFSTKSSHAGKGRLRSVTDSFSRKMPTGNVEEHMSVKNPADVEDEPSKEDQDAISKETTAFESMPDSTDEGKGRNFRLASWTPKPIKNMGNMWNAHPVHYQTKGPDMFPGDDPYLAAPKDQSIASKRFRSHFSLDSTEFLHAAYYTYLNKNIPVYGKLYLGTSVVCFRSLIPGTKTKMILPIKDMENCYKERGFRFGYFGLVLVIHGHEELFFEFSLQNSRDDAEFAVLKLLDVVKPRLNGSPETKTDTETGNAGKSSGHNDQLTEAAKLRMLEDKINAEGYDLPMMIEENPYFKTSITPKKSYKFGLLTIGSRGDVQPYIALGKGLVREGHKVTIITHAEFGEWIESYGLGFIEIAGNPAALMSLMVQHGSMNVGLLRDASSQFRGWIKDLLDTSWSACQGLDILIESPSAMAGIHIAEALKIPYFRAFTMPWTRTRSYPHAFIVPDQKRGGNYNYFTHVLFENIFWKGIGGQINKWRVEKLGLEKTNLYMMQQNKVPFLYSLSPSIFPPSVDFSEWVKVTGYWFLDSKDDYSPPVELSEFIQRARALNKKLVYIGFGSIVINDPKEMTRAVVDAILDADVFCILNKGWSDRLDNDNKTNAEPELFPDCIYNSGSVPHDWLFPKVDAAVHHGGSGTTGATLRAGLPTVIKPFFGDQFFFAGRIEDIGAGISLKKLNSKSLSRALKEVTTNSRIINKAKQIQQEISKEDGVSVAISCIYAELAYARSLVVAKAKGTQSDAKESSSTEENTWFLV

SEQ ID NO: 7764 - protein, 1713 aa, Lodderomyces elongisporus
MPLRDKVHLNFLSPVHSILGHLSGSTVVSEDEDATEDERDHNDDTIVHHNSGEEEQQQQQQQHRHGEKGHNTHDGQSINPKSKPDNDRAATPVQEARSEPLTKRSSTDDEEDTARPCGDASGADFFSSFINNTSLCSGFGSLNNLRKLNFEDFLQGKKNEDLSHDNLEEHKHPNLRKLREKWDDMKPDSITLPVSHKRSGSDYEHKAHPVYAQLKRKEEQEQEQGGKGSNTTTDDEMTSGDDADEDGEDDQEEEEEEEEEEEEEEEKFLAKRLTPSHSKTSLIQTLPSDSPHPTPTSSKIAATTRTKSTKTATATTEAATATTEAAAATSSSLSTSPTKTLSNEDASKTTSTSVISNITSYSTIDSDFSELKVNEKSEKEKSEKEIKIEKHRIDDEARNRVEKQILDGDEQIPSEENLTSLQKSVIQNLDPHSIREGVLIKVRQPHTDQEDHQKNDNKLTESKKRLRFLIAEKLQRTFHLKDDDIFYGNYSSWLVKDVLLQGHMYLTKDALLYFAFLPKRYTIDATAEVNNMEDSSNIIMKGNLGMKTGKLGDTTFVTPVTHKYWTILRPETMSIYSSSTDLYFPITVIDMRTCLYAEIADKEKYREAQLTTPGSRSANVASSGLNSPPSVTDTASELRKMLDEDVGATEDSVEVKSTNVWIKLVTRKKTYRFQCDNLYSARQWCSNLTKTIFQLNNANLSGEVLVKIPIANIVDFRKKTLFDEVDDDDIDPESNDIPLSLSIKYHTNHVVEKRKRDKIKDKLKNENDDVAEIFFLFPKNGTELFNAFDKIMQRPTSSNRNESETSSKIFASLKRDKVELDTSISTLTPSSNFLVKAVIESNMPEPTPRTSEESALKRLGKSIARPRAFTKTSNTQNSIDLVTTDSLSDSSQLSLPIALSEKSLKKLEITFETTMKDFKDATKRYEDKGQLLAAIDDIPLPSNEQNIDEKRNHSRLRKQIKSFSTVGAKLSANPLHYRIKDKYFVQSEHEREVASKNFQKHFSLFNSQLVSSYYCHVLRTLPVYGKLYVSDHEVCFRSLLPGVSTTMIIPMLDIAEITSDDTKLSYAGATIIVQGVDEMTIEFSSSKSRDDFRETCLEILAKLHENEGFRPQPHQWGSNYNIELAKTRMEYTDSERRRLDKDTHDDKRELHLAKQRVALSRIKMFEDRLNAASGLEVPIVLEDSPFFKTEMRPSTSYNITLLTIGSRGDVQPYIALGKGLQKEGHKVTIATHSEFKEWIEKYHIGFREIAGDPGELMSFMVGHSAMSVSFLKDAQAKFKDWIKQLLSSSWKACQGADILIESPSAMAGIHIAEALAIPYFRAFTMPWTRTRAYPQAFFVPEQKKGGSYNYLTHVIFENIFWKGTQGQINRWRVNELDLPKTNLFRLQQTKVPFLYNVSPSVMPPATDFPSWVKVTGYWFLDEGGSDYEPPKELLEFMDQAVADDKKIVYIGFGSIVVDDSASLTKAIVDAVIDADVRCILNKGWSDRMGNKDKNKIEVELPPEVYSSGSIPHDWLFPKVDAAVHHGGSGTTGATLKAGCPSIIKPFFGDQFFYATRIEDMGVGIALRKLTKKSLASALVQVTEDLRIVEKAKKVSLQINHEFGVLAAIESIYTELEYSRNLIAAKDIHNENYKRHHPDFKAQSEPATDSEEESEYGSDKDDDDDTDEEEGEGSSMDEVDDVDAEDAEDADDYKEAREEADETTDDEVHHKKRG

SEQ ID NO: 7765 - protein, 1426 aa, Trametes cinnabarina
MAHTPSTGSPPPTPGSPPTTATSPVAESKHTHTASKGSILQRALEKTRNAPLLSQSQPALPQPSHKRMFSLTRGKGKDRQTNEEHPPTSQSQVLPSPHRAPSKERRRHAAGGDDDSPFITPSSPSLHASRPERPLGFGFQSLHAGTQTFIQALQAVPWAEDQDNDDEFLNHDSTPLSAESDDEDQHVNRLTSSIHAIYRPVARSRRVDTHVSAHALAGTQPLPTVADTDESGVSDEPAISDEDMEGDFETHSPGHVIDARHTGRSSPEPIPGLDTSASDIPDLYRTRERVTSRSGNMSTVRQNRRPQLAEKLRDIFELKDINEVVAEMPCWLLRSVLLQGYMYLTDAYICFFAHLPTKEDQVLKSGSLMKKAQRTKRWIRHWFVLKNDVLSWYQSPADPYFPHGVVDLRYAISCEPVNEKDIRLRTNQKSIRLSADSGKSRDEWIKAIRKVMLKATNMGDSIKIAIPYPAVVDVERSNAMDFSETIEIKVQDRSSDLALDSYFFAYFTDLSIALEQIRDAVRTYRAEPSFQHAPTVVDTTSARSPVAKTGEHPPITPIAGHRPNSPPGFKLTSFLRPLQETLPIVRSASAPGPATDEAKSEEFTHISKRAGSSFVPVATTVEATSPTAGEPPGRPDLLRASTSSLTPTPSVADHTYPPSVSGSSADMRASPSPSTATPAHSNSWSVGMPSWLRLPSRSLFGVSSVPGVRPIVEHASTLPAVHAMPAVTELVSSRASTASRPTTIGSGSGEFGFFSILETPDTMVDSQTIDKFRQEFAFDDKEHLLGMFSGYLYRLLPVYGRLYVSNNYLCFKSSGPLTMRTRMILPLKDILATEKQKSFHFGHHGLVVIVRGHEELFLEFADEDRRDAFASVVQRQLEDVQERTTSGESRSSSDTRPEALILEEFGPRNPLNLSDSQTSSRESAAAHMFTSQSSTFLSFKPDRPLHFTFLTIGSRGDVQPYIALAKGLMADGHRVRIATHGEFKEWVESHGIEFGYVGGDPAELMRICVENGTFTFRGWIDDLLKTSWEACQGTDVLIESPSAMGGYHIAEALKIPYFRAFTMTWSRTRAYPHAFAVPEHKMGGNYNYMTYVLFDQVFWRGTAGQINRWRKNTLGLPSTSLDRMEPHKIPFLYNFSPVVVPPPLDWPEWIRVTGYWFLDDADVGSKKWEAPQDLLDFMAEARKAKKKIVYIGFGSIVVPDPKAMTRCVIDAIVESGVYAIMSKGWSDRLVKNKPAETEPEEPLPKQIYPISSIPHDWLFKQIDAACHHGGAGTTGASLRAGIPTIIKPFFGDQFFWADRVEALGVGAAVRKLTVDSLAQALREATTNEKQIERARAVGQRIRAENGVATAIEAIYRDMEYARSLIKGAAHRNIHEQLFDAEHATIRDYSSTAPLEQSSPSGSIAGPASDWSVISDSDEPLHDSCEP

SEQ ID NO: 7766 - protein, 1300 aa, Lachancea mirantina
MIAYSLVRLASVVKRSFIYVVLYAINKSGFCETLSHLRILWQGVYMITGKIDTVFFKEFCRITCSSYNLNELSLMVFDQSTKNSEEVDFSEGIDDTGSMPARGNEEPNPQVRPLRQSMGSLNIKDDLSPQSDNFLEDELGRDQEDDVARPCGMAKSIVGLLTTASVYAGMGGIDEGQIITEVEDDRKASSGDGLKGDNRQEDDDELAGSMSLSEDDTLFELAIVPTFAGHSNATDGPRSRHSKIYKMLFEKFELDPNVDQMLCSYSCWLLRDVLIQGHIILTECNLLFFAFLPKHDGKTKMSGNLSIVLSIGLGKKRISRYWAVLKDHTLSFFGSPKDLYFPVMTIDLRYAQKVDLCRQDGSPTTEFKIVLENKVFKFKADSDYACRSWCNGLRKQIFAVQNAQDDSLSIKIPLENIVDIDKQKTVADSFTLRIRVLESTDSYAVDDYFLMFLNNSGALLKTAVDKQLANLEMSGSNINFGRNLLPQPDSLESPFTFKDDDRSEAGRGRTIESRRSIFKQVLSPCSRKRDHTQDTEQSPSRSPLKVKERIRSMTDSFKGKQLGKSCIEEDMDVQYFPIEKDSDKSSDEAFPEVGNSMNSESEEAENELDNEAKEEPHFKLINWTPRPIKHMGNMWGAHPVHYLVQNLTLFPEDDKYIAGAKESQTANSRFREHFSLDENESLIAAYYTYLNKNIPIYGKLYVGKSKVCFRSLIPGTKTKMILPIEDMENCYKERGFRFGYFGLVLVIQGHEELFFEFSLRSSRDDAEFIMLKRLDSKISGVKKSVMTLSAEDVLTDQLTKDRALSRDGISKEAKLKLFEDKINAEGYDLPLMIEDNPYYKTSITPKKAYKFGLLTIGSRGDVQPYIALGKGLQKEGHKVTIITHAEFGSWIQSHGIAFREIAGNPAELMALMVQHGSMNVGMLRKASTHFRGWIQELLDTAWEACQNIDILIESPSAMAGIHIAEALNLPYFRAFTMPWTRTRAYPHAFIVPDQKRGGNYNYLTHVLFENIFWKGISGQVNKWRVETLGLEKTNLDLMQQNKVPFLYNISPSIFPPSVDFSEWVKVTGYWFLDEKIDFKVSDELRNFISEARTLGKKLVYIGFGSIVVTDPREMTKAVVDAVVSADVYCILNKGWSERLSPDQAHKVEVGLPACVFNSGSIPHDWLFPQIDAAVHHGGSGTTGAALRAGLPSVIKPFFGDQFFFAGRVEDIGAGISLKKLNSKSLGRALKEVTTNSRLIGKAQQIQKEISNQKGVDTAIGCIYSELEYARSLTTNKANEAKRVLKVTSSPLDEEGSWLMI

SEQ ID NO: 7767 - protein, 1321 aa, Paxillus involutus
MRAGTQTLIQALQALPWVDDPDNEDDATSPINPHMDSDSDDDEQTGPHIASSIHAIYRPVARSRRTETSHSILSGKILPPQKEFQDAVDVERDMNMTSDDDVDADDFEATTPRPADSQKYPLETPIPPPTTAQLGPALRRRAPSRAGSMTTVKLTRRVRLAEKLKDIFQLEAINEVLAEMPCWLFRSVLLQGYMYLTNSHLCFFAHMPSREDQVLKSGTLSKKATRTKRWIKHWFVLKNDTLSWYQSSSDPYFLNGIVDLRYAISCDPAGEREIRLRTNQKNLYLAADSVPSREEWVKAIRKVIFKAQNMGDTVKIAIPYSVILDVEKSSAIDFSETIEVKVFDKEEHYSVDSYFFAYFHDIQNALEHIRDAARIHRTFDPSLPQALLDTTATRSPVSAVQGMDRTRSLPSPDAKSSSSFRLSSFLRPFQDSLPSTLSRMYSAPELPEGAEDFTHISKRGGTSFVPVTSSPMTSSPDSGNITPSSAIGLSTNSPSRNHTYPPSTSAGDLTPASSLSKGLASGVPWNVGVPSWWKIPRKGLNISTSNSAVASTYPVSQCTGGVSEVYSTHQSPSSGQGSAAPGELGYSVLETSEAAVDPEMAEKFKVAFAFDDKETLLGYFSGYLYRPLPIPGRLCVSPNYFCFKSTGPLSTKTKMILPIRDILTVEKTKATRFGHHGLTVVIKGHEELFFEFGFEDRRRAFVSILERQMEYFRKRSKAGEAPALSQGKRDALVLEEFEPRNSLSSDNDPAPLSEALSESLPAVMFTSASSTFLTFKPKEPLHFTFLTIGSRGDVQPYISLAKGLMADGHRVKIATHGEFKVWIESHGIEYGYVGGDPAELMRICVENGTFTVSFLKEGLLKFRGWLDDLLKTSWEACQGTDVLVESPSAMGGYHIAEALRIPYFRAFTMTWTRTRAYPHAFAVPEHKMGGGYNYMTYVMFDQVFWRAISGQINRWRRNVLHLDNTSLDRMEPHKIPFLYNFSPAVVPPPLDWPEWIRVTGYWFLNDADVGAKKWTPPPDLLPFIDSAHQAGKKVVYIGFGSIVVPDPKTMTRCVVEAVVQSGVYAILSKGWSDRLQTQTAETPQAEEPLPKQIYSISSIPHDWLFQRIDAACHHGGAGTTGATLRAGIPTIIKPFFGDQFFWADRVEALGIGTGVRKLTVDTLKEALVSATTDQKQIDRAKLVGEQIRSENGVATAIEAIYRDLDYARSLIRQPANGSTDAAEGSNATKEEQSIDFSTSTLDRSGSRSRYDSFGSHSEDWSVISDGEDRRSSFGSRKSEGKLDRSLTLKRNSLAAAVMSVLPDSLTSATHRHTSSASSTQP

SEQ ID NO: 7768 - protein, 1092 aa, Aureobasidium namibiae
LKDIFNFDEAEKVVAKYPCWYLQSVLLQGYIYITQRHICFYAYLQKKTGVTIKSGYLTKRGQRNPRYKKYWFVLKGDVLSYYKDPSTPFSPRDVIDLRYGVSADITPTQAQDKEIASFSVVTDAKTYHFKAETASSATEWVKQIQKVIFRSRNNSDSVKICLPVDNVVDIEESNFPDFADTIKIRVIDNDETFAVDEYFFSFFGFGEEALRVLRSLTQETSAQRNVTATLSPASGLTSRSARSSSELERSTLDLTHEREESTSSPITKWRSGQKQKQWDQFPRDASESNVSSSDQGNDSEMSESATGTDASGSHILSGSVMFHKPTIGKHHADNVASHNANTQTDVPFAPAKRAGKEPGANTLTKNSPDTQAQDMQQSDSSTLGGLMKVGAVPIQRASGFLYNSGKRVSGLFGGTPSEYYDKFSGMIAGGKKHYAEADELQPGEEVQDSEDEMTVREAEKSFRSHFALPDSEKLVATFFGFFHRVLPLYGKLYVGSTRLCFRSFMPGNWTKLVVPFKDIMDVDKERGFRFGYSGMVIVIRGHEEIFFEFGSQDLRDDCTVTLLRSLDSMEPFQESVLLTEEEKKDAEAAAAENLLLQEARQGDRGDHDSSAVSFDDPAASVLDFKPEESLRITCLTIGSRGDVQPYIALCKGLLAEGHRPKIASHAEFGDWVRSHGIDFAPVEGNPAELMALCVDHGMFTPSFLYETNQKFWPFVKGLLKTAWAACQDSDLLIESPSAMAGIHIAEALGIPYFRAFTMPWTRTRAYPHAFGMQNSRMGGAYNYMTYVIFENIFWKATSSTINRWRKEDLGLKATSMEKMQQDKVPFFYNFSPSVVVPPLDFGEWIRVTGYWFLDEADNFTPQKELLDFIKKARTDKAKLVYIGFGSVVVPDPKKLTLDIIAAVKKADVRCILSKGWSDRMDKKDAKALEVPLPDFMFQIASAPHDWLFRQVDAAVHHGGAGTTGASLRAGIPTIIKPFFGDQFFFGSKVQDLGVGQKVLTVTENALGKAIWIATHDSRMIEKARVLGEQIRSQDGVGTAIKAIYRDMEYAKTLVQQRVARAAQADTDAEDEEEVEVEDSWTLVENDSDPDAT

SEQ ID NO: 7769 - protein, 1467 aa, Histoplasma capsulatum
MPPDDESRTARSSSSSKPHLASTYRLPQSHIPDRLRMGDDEHEDMTAPPAGTAGRGGRFPYMHQSVFSMIAAASSKNDFHSRFDESSDAEDEDADVARLPKDRFLSNDGVDGRRDGGASTSHVLNIAKRDKSSVPNAAEDRGRPHHRKRLSENKFLKSLAKLPHRGKGKVPAPEPEPDLDPTVTSEPSSAKAVRLVAATEAPVLSRMLDAQSRFGESEPLLNPTEPPGKTCCQRKELSPSSLLSARLMDIFGFDRPEKVISEYQCWLLQSVLLQGYMYITEKHISFYAYLPKKPHTIIKSGYLSKRGRQNPKYNRYWVALKEDVLSYYMDPSNLYFPSGHVDLRYGISANLAEQKGKDKDTDNNVKDFTITTNNRIYQFRADSATSAREWVKTLQKVIFRSHNDGDSVKISLPIENVIDIEENPVIDFAHTFKIRVVESGESYAIDEHIQQAMLVPDGGHISGCRRSHSVDVISHPSTHETTLLAEAVKATLRPLSPLDSQYGSPKQSQDLPRSHFRTFSRGRRQHSRECSEAGFEQKRSDSTNRASVGDNQDERSAGGKLQNSSDSFVQSLEHATESSAILQSTSGTVESASQILNRSDVFRSPTIHRLQNSLPGSGEAPRRHSEDTARFPPTSADLLPLRTQTTQSLMKQAQQDAGSDSEHDLQHRSVAPSASSPTLQELMKAGSYPLQRAAGFAGYLRNRSKHMSNLLATESMGYFEKVSGMWIGGKRHYGDGETILSDDKMVDPEDEEQGCEHGDRFRTHFALPPSEKLQATYFAYLHRVIPLYGKLYISNRKFCFRSLLPGTRTKMILPLKDIENVEKEKGFRFGYHGLVVIISGHEELFFEFNTADARDDCAVTLHQNLESIRYLVESGLLAQQEREEADAAMAEHQMLEEARLEGMDEQQSSQTLSTSMPLSSTSSPILFDDPRVSIVNFKPQEALRITCLTIGSRGDVQPYIALCKGLLAEGHIPKIATHREFEPWIRSHGIDFAPVEGDPAELMRICVENGMFTYSFLKEASSKFRGWIDDLLSSAWTSCQNSDILIESPSAMAGIHIAEALGIPYFRAFTMPWTRTRAYPHAFAVPEHKMGGAYNYITYVMFDNVFWKAIAGQVNRWRKRELGLRSTNLDKMQPNKVPFLYNFSPSVVPPPLDFCDWIRVTGYWFLDEGANWQPPVELENFIKQARADEKKIVYIGFGSIVVSDPAALTKTVVDSVLRADVRCILSKGWSDRLGDPSSAKAEIPLPPEIHQIKSAPHDWLFSQIDAAAHHGGAGTTGASLRAGIPTIIKPFFGDQFFFGSRVEDLGVGICMKRLNVSVFSRALWEATHSERIIVKAKTLGEQIRKEDGVATAIQAIYRDLEYAKTLVRQRSPTTSAPQTAIYAVSNEESAAMISSETSPDDDGDGEDDADADAAMEDSWTFVGDETETDVTKKTRARERDYDIRLDNVATAGVINGSGGYGSDSGKG

SEQ ID NO: 7770 - protein, 537 aa, Rhizoctonia solani
MIASRSSEGVSAQRDPVSPENAAFGSTSILSEASAHTYPPSPSHQVPPSTHSNRTSISSNWSVPGYNWLRGKGVFSTPSSIDWGSRSTEGNVSEVISSPRLDQSELSVSSEGHNLGYSMLEAADESKIAHAALQEKFRSTFALDEKEELLECIPGSLFRVLPVYGRLYVSTNYFCFRSSQPLTRTRMMIPIRDILSTEKQKPFRFGQHGLVVVIKGHEELFFEFGSSERRDTCRSGLDRQKEALQKQALSPVSPTPTQGKRDALILEELEPSMLISDDDPRPAPEVLASDAPVMFASTSSTLLTFKPEKPMHFTCLTIGSRGDVQPYIALCKGLQADGHKVRIATHKEFQPWVEGHGIEFALVGGDPAELMRICVENGMFTVSFLREGVQKFRGWIDDLLETSWLACQGTDVLIESPSAMAGIHIAEALKIPYFRAFTMPWTRTRAYPHAFAVPERKMGGSYNYMSYVMFDQVFWRGISGQVNRWRRHTLRLPSTNLDKLEQHKVPFLYNFSPTVVPPPLDWYEWIRVTGRSMNMLS

SEQ ID NO: 7771 - protein, 1258 aa, Heliocybe sulcata
MTSSLHTIHRPIDRSRRVESTALRNVFTVSPEESDDDKEQEMAANSEPEDADFEVETPRVDQTPPGFSSIVASSHKSIRGRAEGHQSATARSGSMATVRLQRRARLADKLKDVFDLEGIEEVVAEIPCWLLRSILLQGYMFLTNSHLCFFAHMPARENQTLKSGSLNKKAQRTKRWIKHWFILKNDVLSWYQSSSDPYFPHGVVDLRYAISCEPVKDRDFRIRTNQKTVLLAADSTSSRNEWVKAVRKVMFKAQNNGDTVKIAIPYSAILDVEKSSALDFSETIEVKVIDKDDSAIDSYFFAYFHDLGTALEQIRDVIRNYRTVTQGSSPQPIMDTTIPRPVNIPSNPADQTAAIERTLSLPGADHLSRAYSAFRMPSVWPLSRGTQSEQHGTADNEEFTHISKRKSGSSFVPFTTSPKGEKSQLAPADLGEPSISSEGSSRISSSLSSDHTYPPHPSPSDSYNPLGSDNGGGRWVVSTWLKVPSRSVFTFSSSGSRPSIEHSTTLPTMPTSATSESFSHPSSPHRSSDLGFSILDQPGSAVDPDMQENFRSYFAFDERETLLGYFPGYIYRLLPQPGRLYISTNYFCFKSTGPLSTRLRMILPLRDILAAQKSKAFHFSHYGLILVVKGHEELFFEFSHEDRRTAFISLLENQLEDVQNRQASRSPQQRDPLILEGFDSKTSLVQSMPDAPPPQESLDESVPAAMFTSSSSTFLTFKPKESLHFTFLTIGSRGDVQPYIALAKGLMADGHRVRIATHGEFREWIEAQGIQFSCVGGDPAELMRICVENGTFTVAFLKEGLTKFRGWLDDLLKTSWEACQGTDVLIESPSAMAGYHIAEALGIPYFRAFTMTWTRTRAYPHAFAVPERKMGGSYNYMSYVLFDQVFWRAISGQINRWRRNVLGIRGTNLDKMEPHKIPFLYNFSPTVVPPPLDWPDWIRITGYWFLDDAEVGSKKWTPPTDLVDFIDTAHAAGKKVVYIGFGSIVVSNPKAMTRCVIDAVVKSGVYAILSKGWSDRLEVKSGDASEIEEPLPKQIYPITSLPHDWLFQRIDAACHHGGAGTTGASLRAGLPTIIHPFFGDQFFWADRVEALGIGSGVRHLSVDALTAAFVAATTDEKQIARARTVGEKLRSENGVAVAIEAIYRDLERARSLIKNPHDNPDGENATIRDAVNVNASSRSTPERPSPVESSTESIGASEDWSVISDGGTSDGGHSRPDMRRRSSLGAAVHSVMHKSSRSSRANSRASSPPVPSYPPRSR

SEQ ID NO: 7772 - protein, 512 aa, Cephalotus follicularis
FNQLHSTVTASTTKWKRRKHRGRHPLLPSWPSAIAAAFACDQTQYHVLLITHSAHQNLSSHLAEKHVAYFPISSLPVVSTRDDHGSLKSEFSLQKRIVTREHRRECYAAVESIFGNGPCMEGDFIVINFFALEGWSLAELFCIRCIVAAPYVVPYSAPSSFDRHFRKEFPQLYRYFQEAPDHKVSWKDVIHWMWPLFTDNWGPWRSEDLNLSPCPFTDPVTSLPTWHNRQASPLLLYGFSQEVVECPDYWPSNVRVCGFWFLPIDWQYSCKNCGEISVLSPTRHLRKKEELCSAHIELESFLKAPASTAPVFVGLNSVGSMGFLKNPQAFLRVLQTVLQITSYRFILFTAGYEPLDTAVRVIATESCSLSYQKHSLFNSRLFCFSGMMPYNWLLQRCVAAIHHGGSGSTAAALNAGIPQIVCPFILDQFYWAERMFWLGVAPEPLKKSYLVPENTDPKSITEAATVLSKSLHDALSPEVRARALEIAKRISLEDGVLEAVNILKEEIRCKKD

SEQ ID NO: 7773 - protein, 1044 aa, Batrachochytrium dendrobatidis
LTVAEKIQTVFELPETEPYRGEFACWLVRSVLLKGYMYLTSKHICFYASLYKSTRDIKSGFLKKRTTAKLYNTNWFVLKGNTFYAYGNSTELYYPLSTISMKSIVSVCVSKLSKTGFRIRTTSKKYAFEADTETLCNEWVAALRAAVFRSHNMGDDVRVVFPLSSISEISIAKSIGLDDSLRIKIVDSEFLISEEYYFAYFNDANRACDTLIALWESVRNEAKHNVVRKRVSLYDTTALTGLPSQPLDSHAKLGKQTNGFLGTTNDDMPATSSSSLLQSGTSLPALFRKSSVASQLATKAENGIAIGSVSNSPLSRPSLHHRAQTDMNLFDEDISTSYNQADSGSNGGLNLPSRHHKSSHTNLEKQQSSLTNINGLLSSGAVESLDKETPPFLSTLTPAKPDSSIRRNWWGHRKTISDGADAFGPAFSTSFNVLSKLDPGATTASQQQKILTFHKDFSVPETEILHATYSCYLDRVILRLGKIYISDHFLCFKSKVVGVRAKVMVPLSEIINIDISRKYTSLYYALVITTHTQEEIKFDFQSFESRKKIYNVLHKLLYTSSNKVEPNNDELSAHEQKAALLKDISLSETHVKSVFSQYEIAYIPPILDPERPIKLSEKMHITCLTIGTRGDVQPYIALCKAFMADGHTCRLATHLEYQDWIEGFGIEFRPVMGNPAELMQLCVDNGLFTVSFIREAMGKFRGWVDELLLSCWDAVQGTDLLIESPTAMGGIHCAEKMQIPYFSAFPMPWTRTKIYPHPFAVPEYHLGYGYNLMTHALIEHIFQKGVAPQVNRWRRQSLDMPTMNLGLLSEHKMPFLYSFSPSVVPPPPDWQDWIHTCGYWFLDNPEHGWEAPASLTKFMENGAKPIYIGFGSIVVPDPDALTRTIIEAVKKAGVRAILSKGWSVRLAKDSATAGQTETPIEYPDCIYPLDKVPHDWLFPLMAGVVHHGGAGTTAAGIRAGAPTLIYPFFGDQYFWADRVQDLGVGLSIRKLTVDKLASALVTLTTDHKMRERSALLGERVRCESGAANAVQYVYRDLEFAKQRI

SEQ ID NO: 7774 - protein, 553 aa, Melampsora larici-populina
MFQSTTSDFLNFKPNRTLHITCLTIGSRGDVQPYIALCNELAKDGHRTRIASHGEYKDWIEGYGIEFVEIGGDPAELMKICVDNGMFTLSFLKEGLTKFRGWLDDLLSSAYEACQGTDLLIESPSTMAGIHVAEALGIPYFRAFTMPWTRTRTYPHAFAVPDHRMGGGYNYMTYTVFDQVFWRAISGQVNRWRKEKLGLRSTTFDKMECHKVPFLYNFSPSIVPMPIDWFEWVHITGYWFLDEGQGEDDKKIDQELIKFLNRSREMGKKIVYIGFGSIVVPDPIGLSKMVIEAVEKSGVHAVVSKGWSDRMSKKDNQPQKENQTKEDDELINESEQIFNLQSVPHDWLFPKIDAVCHHGGAGTTGASLRAGVPTIIRPFFGDQYFWADRVEKLGIGLGLKKMNVKSLCKALEIGTKDEVMIKKAKMIGELIRSESGVSKAVESIYRDLEYAKSLIKKNKTKELGGEEEDQENQEEEEENQMESSDQCEIEESGSGETEESQLEELDGCEGLEGDDEEDLEEGEGAEGEGEEEDNSSWDHLSQPSMSPFFGPLS

SEQ ID NO: 7775 - protein, 701 aa, Withania somnifera
MDSNGHNGTTKSLQDLGDGVETTGRLGKSLDRTSDVDSSVQLDKKSLDKQLPRALDQSTSHLEVPDNSDERCDAGFSDELDGWRTSSSSLVDTRSSDEHSDDCLTPEMKYQRTHPLQPSLVLESPESNGWSSSVPPRARRGLEHCITAPVTTHRSLFLEGQDMAFSRSLTERRDSPGHNLILDRLSEREKQKLIVEMVRIQRDGTVEVDLTKNTPVASELLELQSVEGPIPTVDRIITDFNKSVPKLRISVLVVGTRGDVQPFLAMAKRLQAFGHHVRLATHSNFRDFVKSAGIDFYPLGGDPRILAGYMARNKGLIPSGPGELSIQRKQITTIIESLLPACTEPDTETGEPFRAQAIIANPPAYGHAHVAEALGVPLHIFFTMPWTPTYDFPHPLARVSQTAAYWLSYIVVDLLIWWGIRNYINEFRKKKLNLPPIAYFSTYNGSISHFPTGYIWSPHVVPKPKDWGPLVDVIGYCFLNLGNNYQPPEEFIKWIQNGPKPVYIGFGSMPLEDSKKTTDLILEALKNTGQRGILDRGWGDLGTFQEIPENVFLLAECPHDWLFPQCSAVVHHGGAGTTAAGLRAGCPTTIVPFFGDQFFWGDRIYEKGLGPAPIPISKLSVEGLSDAITFMLQPDVKSRAMELSVLLENEDGVAGAVDAFHRHLPSEIPLPTPPPEECDGPNLLQWLFTRIGKICCLPCGS

SEQ ID NO: 7776 - protein, 1294 aa, Lachancea dasiensis
MARKDQPDVRVYNGASSAAPESEQRPQQRRWIRSLSPVGKLYRSSAGLVHLRNRSLSVRTSNSAVSDSQESETSNSHVSKEHDHDLARPCGMAKSIVGLLTTASVYAGMGDLEQAHQTGEEEEGKEDDEEEELEDDDEEEVEELEDDDDVEGGGGEEEEEEEEGEDEQEERDNYSVFLDNNSRKKPQDGKGESVPGSPLLALQAADEADHTSDSLRSSSDLDSLANTVTHFSKKDSLFELSVVSNNDANSLSSSSSRSRRSKIYKKLLSKFNLSEDEDQFVTKYSCWLLKDLLIQGHIVLTTRHLLFFAFLPKSTGTPKMSGNLSIISGVGLSGRWTRYWSVLKDHTLSLYNSPRDLYFPLLTIDLRYANRIELAKHDEEATGHFKIHTEAKVYKFRADSGYASRSWCSALKKQLFATQNSDNDSISVKIPLSNIIDIDEQTVVAQSVTMRIRVLETPQSFAVDDYFFMFLSKKDANLKEMINRLLLDVGQSHPKKLEAERTLLSNDISLNTDLSLGREIRQNKTGLGSGKIIKRVLSPVTRVHRPSFSMSIPFNSRLPQRTKESHFSKDEEVNAPSGQGSTNKNSDLSSPEHIEAPDDGLSESDSYFGTVEDNKGRIMSLASWTPRPIKNMGSMWGAHPMHYRYNDEEMFPDDDQYLANSKEQILASQRFRSHFSLRQDEALTAAYYAHLNKNIPVYGKLYLGSSVLCFRSLLPGTKTKMILPVSDVENCYKERGFRFGYFGLVVVIHGHEELFFEFSLQSSRDDAECLILKQLDSTKAQTGGLGDVGKLTNNFTATTLSAEQQVSEAAKLRLFEDKISAEGFDVPVMIEESPFNKTTLTPKKSYRFGLLTIGSRGDVQPYIALGKGLLAEGHRVTIISHGEFQDWVTSYGIDFREIAGNPAELMSLMVQHGSMNVGLLREASSHFRGWITKLLETAWLACQNLDILIESPSAMAGIHIAEALRIPYFRAFTMPWTRTRAYPHAFIVPDQKRGGNYNFFTHVLFENIFWKGIGGQVNKWRTETLGLGKTNLMLMQQNKVPFLYCVSPTIFPPSVDFSEWVKVTGYWFLEGEEDYVPPKALVDFIAKARSSGKKLVYIGFGSIVISDPKKMTKAIVDAILEADVFCILNKGWSDRLGGDDKSDTEALPSCIYSCGSVPHDWLFPLVDAAVHHGGSGTTGAALKAGLPTVVKPFFGDQFFYASRVEDIGAGISLKKLNSKTLSRALKEVTSNSRIVHKAQQIKHDIFRENGVGSAINCIYSELEYARSLVLEKNKDMKKTTKVGSSPEENSWLLV

SEQ ID NO: 7777 - protein, 1801 aa, Ophiostoma piceae
MQPPIEPAPTASPAVTPAATPAATPSPITTAAASAAPASASPNPTATPTPPAAASRAPLSPLAASTSQLPQLPRSSTSSAPPAHPAHPAPLTTTPLPASFKHTRKPSRLSALSTILPAISTNTASLPVSPRSDDEGLSQSQNNRNRAKRFLKKRERVTSPRESRMEFPERLRRKDRGDNDEEVIRPNATTNNVFMGVNQSIFGLIAAAGSQVNFNDLGHSSDEDEDDDAGGDVVVARPPPRVASPLSTPDDDDALEAFVKPRRKARFGTDGTDEGKDKDDADKPKRHHFRNISQSSIFKRDKSDKSRDSKEDQDKRFDGKLLRSLPALPALKMKKRLSMRKSSASRSRTRDEHGEDGSQTPTERDDDSPTIQVTRDRSSSMRSIAPVMSRMLEAKAALATGSGSGRDDRGDRGDPTANKSSDTSTNSLTADEGYAYADAADNSNDDADADADAKATSALERKLMDIFEFDKPEQVVEEYPCWLLQSLLLQGYMYITSHHICFYAYLPKKANEVAKSGYLAKSGKRNPKYSRYWFRLKGDVLSYYRDPSNLYFPHGQIDLRYSISATVTPASGGGDGLHFQVVTNNRTFYFRADSAPSAKEWVKSLQRVIFRSHNDGDSVKISLPIDNIIDIEENPSLVEFTDTCKIRVIDNDETFAVDEYFFSFFEKGKDAIRILKILIDDAGKDDVRDGRDKDRLDVIRHSEDHMSHESGAASTGAVGPTSQLSAAPLSAVSATSPSVPGRAPRLDSVRATLQPGASSPRASGEFPRSSFDALRSSFTGGPAANSRKSLDLSQAIGGNAIRRSFSDRVGPRASTDRQRHSSSHYRSMPHGSSPVGHADKTDKTDKTDKSELGDSMQTSFSNLNASSSDDPSASQILNGSEVFKTSVDKSDKSDKPDKTDKKAKKDKEKRDKKEKRRSMGLPHAATTGQLNVGGCDMADGYPTDEAGLTHNLARLGSFPLQRAGAYADWLNRTSRRMSSLLATESMGYVEKVSGMWKGGRQHFDDGESGGELEGVPTDMENSSTLLQQPHPLTPGLPDAGADTIVSNEHFREHFALPDSEKLQATYFGHMMRVLPLYGKIYMSSRYFCFRSMLPGTRTKLILPLKDIENVNKEKGTRFRYAGLVVVIRGHEELFFDFFQNDMRDECALTLMRLVERARYLKEAAVPELEEDPDEKEVAEAALAERNALQEAREAAAAASAAASAAASTSASISGVSDSPIVSDKERERTEKTVLRQPTFTSEAPTILFDDPKASFLNFKPSEPMRITCLTIGSRGDVQPYIALGRGLVKEGHSVCIATHPEFESWIRSHGLDYARVEGDPGELMRICIENGTFTLQFLREANSKMRTWLDELLSSAWTACQGSDLLIESPSAMAGIHIAERLQIPYFRAFTMPWTRTRAYPHAFLMPEHKMGGAYNYFTYTMFEAVFWRATAAQINRWRKKTLGIRSTSLEKMQVNKVPFLYNFSPRVVPPPLDYSDWIRVTGYWFLDEAAAGSGVNDTTWTPPADLTAFIDKARADGKKIVYVGFGSIVVQDPAKMTQEVVDAVQRADVRCILSKGWSDRMAKGEGAGSAADEPAMPDEIFQIKSAPHDWLFAQIDAAAHHGGSGTTGASLRAGIPTIIRPFFGDQFFFGQRVEDLGVGLCLKKWGAASFAEALWEATNSARMIRKAAILGEQIREENGVDTAIQCIYRDMEYAKSVVKEKVAKSGQTVGGGSGTVGGLDESAEVLPANVSQAQDSAADDEYDDDVPEESWTFVGEDADPMQQSVILARPSQSQSQEGSRSQTPVAGYRSLSTRILGIAK

SEQ ID NO: 7778 - protein, 1225 aa, Eremothecium sinecaudum
MSTRGSKRRLKVPKTPAIPLKLIKVRALASSALLKISLKAPLGIKSYTLPPPFKVHKEERQTMIWTADEASTSPGDRDEDFASPHVLARSIAGLLTAASMYVGIEDIHRAEQIGTNEEESSAEPGDDNAEVKADEEVEEGSIFSGAPSFSGAQSRRSTLFELSIVPNTEMTSVQQSRGRNWTSRIMSKLKSKFNLQEDEQLVKEYSCWLLRDVLIQGHIYLTSKNLLFFAFLYKADGAARLTGNLSISTSSISISGKLTRYWAVLKDHTLSLYNSSTDLYFPVLTLDLRYVTKVQHCKQNGVETRKLSVVTDSRTYSFFTDNEHFARSWASAIKKQVFTTQNSDNDSMSIKIPLCNIVDLEDHAIMEKGMTLRIRTMESSETFALDDYFFMFFNNAGNQLTDIIKAQLADLEMLGSQVMIKYGSNSSPIELSGSSSPVQPVLESSFETRGRSDVKIKSRSFVTASRTPPPIGRGCVPSVTYPLSKSPSKVRNRFRTVTDSLKLTSPKIGKSEDSSASDVKGANTESTDGVHSNIDNNSSEQETFDTNRNKTVYWNPKPFITMRSMWNALPIHYAAEGLDLFAKDDELLMSDPVEAKAADKRFKEHFSLTDDESLIASYYTYLNRNMPWYGKVYLGKSVICFRSLLPGSKTKMILPLRDIENSYKEKGFRFGYFGLVIVIHGHEELFFEFALQRSRDDAEYLILKVIDTLRPLTVELAKDNDSIDQRFKNTHIQDPTNDGKLRLFEDKINSVGYDIPIMFESSPYFKTTITPKKIYTFGLLTIGSRGDVQPYIALGKGLMQEGHKVIIITHIEFGDWIKSHGIEFRSIAGDPTELMALMVQHGSMNVGLIRDATSKFRDWIRDLLTSSWEACNGIDVLIESPSAMAGIHVAEALQIPYFRAFTMPWTKTRSYPHAFIVPDQKRGGNYNYFTHVIFENIFWKGIHGQVNKWRVETLGLPKTNLEFLQQAKVPFLYNISPTIFPPSVDFSEWIKVTGYWFLNESSGYEPPQTLVDFIAEARANEKKIVYIGFGSIVVKDPAKMTAAVIEAVVKADVYCILNKGWSERLADPAATYLGVDLPPCIYNAGTVPHDWLFPQIDAAVHHGGSGTTGATMRAGLPSVIKPFFGDQYFYATRIEDIGAGVALKKLNANTLSRALKEVTTNSRIITKAKKIGLDISKEDGVATAISFIYSEMAYAKSLVKMKNHDNKQLSKDTKHIANDESWLML

SEQ ID NO: 7779 - protein, 1230 aa, Torulaspora delbrueckii
MNLATKGRKSGESSSHNISQESVGTGKLLTALIPQRRLSKSIASLKPGRNGKGRTASIGSDGEEMVRSDSDDTGGYDVAKSRFMMKSIADLLTTASVYAGMDDAQEADDLAQDLTQNDKDRRNEDDDLLGRQQKDSNDEVQADSEGGPVRLAATRKPTLFSFSVVPTEKMESAMGSDQAFKRKIIKKLLEHFKLDQNEELLKDYSAWLLKDVLVQGNLLVTSRHILFFAYLPKNPGTIKLSGNLNIRSTLRTSVRYWCILKDQTLSLYNSPTEVYFPVLTIDLSNTTSIHLEKRSSSDDPNTTFKVHNNGRTYVFNADTEYSARAWCNSLKKQQFAAQNTENDSVSVKIPLANIIDLDDQAIVKQALTVRIRALESAHSFAIDDFHFVFLDGSGFSLMDMVKKQLSALNTLGVRILFDNFSPGDDPNSSAKLEGGRKCIEDTKTQESSQTSFDMSSKEHASLIDNILHHTPGSLAAKDPEEKTWSRRLRSMSGSLFTKPSIFNGSDEDVVVEFYSRFPTQASDNASRSTLKDQFSDDDDKATESEHGHRKTKLTDLATKPFKNVAEMWNAHPIHYMNDYVPFSEDDPYLVKNKRKVHALHRFRRHFKLNNNEILISASFTHLVRNVPLYGKLYIANDVLCFRTLLPTVNTKMILPLNDVETCYKEKGFRFGYLGLVIVIRGHEELFLEFSTASARDDAEYVILKRLDDVKSKRRVPASVSANIVETDSNTAKLKFFEDKINAEGFDVPLLFDENPYFKTNIKPQRSYKIAMLTIGSRGDVQPYIALGKGLLKEGHQVTIITHSEFREFVTKHGIGFEPIAGDPAELMSLMVEHESMNVGLFRDASVRFRDWITALLDTSWAACKKLGLDMLIESPSAMAGIHIAEALDIPYFRAFTMPWTRTRAYPHAFIVPDQKRGGNYNYLTHVLFENLFWKGISGQVNKWRLESLGLDKTNLDMLQQNKVPFFYNISPTIFPPSVDFSEWIKVTGYWFLDEKTDYKPPQALVDFLSRARKLGKKLVYIGFGSIVVSNAKEMTKAIAKAVEDVDVYCVLNKGWSERLNDSSSKEIEVELPECIFNAGNVPHDWLFPQMDAAVHHGGSGTTGATLRAGLPTVVKPFFGDQFFYALRVEDIGAGLALKKLNSHSLTKALQQVTTNKRMADRALLIKNQIANEDGVRTAINCIYGELEYARSLVLARSKKEKITPYKEVQTSEPLANKASNNQADESWFFV

SEQ ID NO: 7780 - protein, 606 aa, Vigna angularis
MGHDELVTVDNVSGDELESTSSEKEENWSENLEQNSSEVNSTSSEVNSTLGVGPVGTESNLLVAADNGILFPKSMMEFWDSPRQDLIVDRLSECEKQKLLNLVKIQNDGTVDVDLEKGAPLVSELLKFQSFEESTTSASVVSESKISAPWLQIVMLVVGTRGDVQPFLAIAKKLQDYGHRVRLATHADFDTFVKSAGVDFYPLGGDPRALARYMVRNKGIIPSGPTEISIQRKQLKAIIDSLLPACIEPDLETGIPFRAQAIIANPTACGHTHIAEALGVPLHIFFTMPWTPTYEFSHPLARVPQSAGYWLSYIIVDVLIWWGIRGLINDFRKRKLKLAPIAYFSIYNGSINHLPTGYMWSPHVVPKPTDWGPLVDVVGYCFLNLGSKYQPQEDFVRWIQKGPKPLYFGFGSMPLDDPKRTTDVIVEALKDTGQRGIIDRGWGNLGNLAEVPENVFVLEECPHDWLFPQCSALVHHGGAGTTATGLKAGCPTTIVPFFGDQFFWGDRIYQRGLGPVPIPISQLSLENLTNAIKFMLQPEVKVQAMAIAKLIENEDGVTAAVDAFHRHLPPELPLPSPSPVVEDHANPLQWFFVQLAKLCTLPCGSV

SEQ ID NO: 7781 - protein, 2082 aa, Pseudogymnoascus sp.
MPAPSGDGNNLHKYFSSQTPVAAMVKKESEESAPAAKIEAPKDSKMSAFERKRLENIAANQAIMKDLSTTAKKIIPKTAAPKPPRSKTPRKREPPVKKEAARPTRTSSRIAGLEADGEGAKRKFEEEFQFAPDEAKAKKMRVAGDLNLSDIAVEGKKWTNDDTLLTSIMRGAQPYERTFDESDIKTTTDQELKFLREKMSGLELYKTWEPNDIKITPERIYSMGFHPTHDKPLIFAGDKIGNLGIFDASQEGEVDDDGDQTAEPVITAFKLHSRTITSLLFPTNHTEMYSGSYDSSIRKLDLQKQVAVEVYAPPSMDDDEAISAIDMNSNDPNLIYFSRLDGAFGRHDMRTKKDTDIWYVSEKKVGGFSLHPLHPHLIATASLDRTLKIWDLRKSTGKGDERQPGLLGEHTSRLSVSHAAWSSSGHVATSSYDDTIKIHSFTKAKAWGVGHDIKEEDMEPTAVIRHNNQTGRWVTILKAQWQQRPDDGIAKFVIGNMNRFVDIYTSEGEQLAQLGGDGISAVPAAAQFHPTRNWVAGGTASGKMCLWIRQPEGLIAIGTTPPTQIFTTTPASAVATRQNTRHIEVVIPLKRARIMIRSHDDIKKRVGRKLTKKRREDRRVTMEIPQRFEDGDDADEDCTAPKGQNGVINQSVFGMIAAAGSQVDFHSRFDGQESEDDEDDETTEPDDASKPSEDSSDPSTSKPATDERRSRHRLHRRNLSDNKLLRSLSQLGIKHRSKHAQLSTASSDPVTPEKIKYTERDHAALSPFKGPPIMSQMLEAKAAAVQRASFDSRRSDYISGQSDGADAEEGSPSDLAIQLKEIFEFESPEMVIDEYPCWLMKSVLLQGYMYITEKHICFYAYLPKKSNEIVKSGYLSKRGLKNPKYNRYWFSLQGDVLSYYTDPSDKYFPAGNIDLRYGISASVVDKEKTFFEVITNHRRYQFHADSIPSAKEWVKALQKIIFRSHNDGDSVKISLPIENVIDVEDSPVIEFAETCKIRVIDNDETYAIDEYFFSFFSFGKQALNVLRTLVSDSAAKQIPEDMLVPAQGTSGNNSPKAGSSRPSLTIATKESKPFLNPSRPTTSGLEDSVKATLTPLMSSPLHVHSPRASGEFSRTSFDINHQRSSSQTRPTRRSMEVSRLNLDGNGRNGSPSGDRRSFSRNRAAEKRNSEKQDSSDSYVHSMEESSAAAQSASEDATGSASQILRGSEGFFQPTIHRSASASRRRDDPLLPPTPTLPPHAATIDALERPKLTQADSGSSPSLQTLAKAGAYPLQRAAGFANYLNRHSKRMSTLLATESMGYVEKVSGMWKGGKKHYDEPLGHGLEDDTDDESVGQTEAAQQRFRAHFALPPTEKLQAAYFAYLHRVLPLYGKVYISNRSFCFRSLLPGSRTKLILPLKDVENVDKEKGFRFGYSGLVVVVKGHEELFFEFRQPDARDDCCVTLLQNLETIRFLKETGLLTQEEEESAAWAVAEHKALQEARHESRQHIHDVELPTTAEGASTETAPIMFDDPRASILNFKPTESLRITCLTIGSRGDVQPYIALCKGFIAEGHRPKIATHVEFKDWIEGHGIEFAPVGGDPAELMRICVENGMFTYSFLKEASTNFRGWIDDLLSSSWLACQNSDVLIESPSAMAGIHIAEALGIPYFRAFTMPWTRTRAYPHAFAVPEHKMGGAYNYITYVMFENVFWKAIAGQINRWRKKELSLPRTSLEKMQPNKVPFLYNFSPSVVVPPLDYSDWIRVTGYWFLDEGTDYKPPKEISDFIAKARADGKKLVYIGFGSIVVSDSAALTKTVVNSVLKADVRCILSKGWSDRLDKLGATEPEILPDEILQIKSAPHDWLFTQVDAVTHHGGSGTTGASLRAGKPTIIKPFFGDQFFYGSRVEDLGVGIYLRKLNVSVFARALWEATHSERMIIKANLLGEQIRSENGVDTAIQCIYRDMEYANSLIKRKTGSHHEGLAEDIEESWTFIGDDNDPELMSRIHAWDPRVVMAQAKEGELAKEVEGVELTDSPIPTSRSETPLPSEKEGGSNCASLTDERSNLPPTPGSRAYTLGPRHYKLPSHLSPTCFRRQPQANGGNNNG

SEQ ID NO: 7782 - protein, 420 aa, Starkeya novella
MRIAIHVLGTRGDVQPYLALSRGLRLRGHEVLLVAPAQFAGMAEAENLAFAPLPGDFLALLETPEARAVIGKSRAGFGAGFKLIGHYRHLARGLLDAEWEAARAFHPDAILFHPKALGAPHIAERLGVPLFLASPLPGFTPTAAFPTPLLPVRSLGPLNRASHALMIHGGNVLFSKTIRTWRAETFGSSGRSRRPPLAGTLYGYSPQVIPKPSDWGPDIAVCGYWFLDMPNWNPDTDLAGFLRAGEPPIYVGFGSMPGTDPEGLTRLVIEGLRRAGRRGLLATGGGALGRAEAGERIHFIAGAPHDRLFPLMHATLHHGGAGTTGAALRAGKPMAICPFLGDQPLWARRIEALGVGTRPLDKRRMTADDLATAFRSMDHPAMRTHAEALGIAIRSEDGIGTAVSFIEERLTRAKPGASAV

SEQ ID NO: 7783 - protein, 867 aa, Phialocephala scopiformis
MAQYQVYEMPSSLDALEGHELPSSRTSSETYLDSPPAYEAVAGQLAQEAAEVRDDGRITVDLNSRLARTLSKFMPKCPIYSAGEDRRGEKPAQEPKPISWNVKLNIVVQVVGSRGDVQPFIALGNELQKHGHRVRLATHNTFRNFVESHGLEFYPIGGDPEELMAYMVKNPGLIPSMKSLRQGDIQQKRAMVAQMLTGCWESCVEPDPISGIPFVADAIIANPPSFGHVHCAQALGIPVHLMFTMPWTNTRAFPHPLANLKNGGKDSKLGNYTSYSVVEWLTWQGLGDVINNWRETMDLEPVSSMDGPNLAAQLKVPFTYCWSPALVPKPIDWAPHVDVCGFFFREAPNYTPPPELDAFLRAGERPVYIGFGSIVIDDPIKMSNVIIEAVHKSGVRAIISRGWSKLDGPAMDNIYYLGDCPHEWLFQHVAAVVHHGGAGTTACGLLNGRPTTIVPFFGDQPFWGNMVAARRAGPKPIPHKTLNSQNLSEAISLCLTPEANAAAKDIASSMQQESGVRTAVQSFHDNLPFEKLSCDILVDQPASWAYKKKGKSLKLSKLAVEILRTNHKFDTKKLELYEPRPIHITTKYYDPVSGSTAAFIGWNIDVVEAAAGMVTKPYKEYKVGRTTTSTKSVTSETSSLRTRSSSSSTEVESLTTVSGITSPTSSRFSSSRKSVDVSSPPGFGCTAARMAGASAKSFGDLNVKGFKGLLVDIPLATAEGLRNVPALYGDKIRDHGTVTDWKSGAMAGGKAFMYGMGEGLTDIFVEPYKGGKKEGVVGVAKGVGKGTVTLLTKTGYGMLGLVAYPGQGIAKSIRTAVKSRTRKVIANVRHEEGQYLLKGPIGREINHAQVTAVFDHFMAAEGAAPRT

SEQ ID NO: 7784 - protein, 1599 aa, Meyerozyma guilliermondii
MADNEPAMATKQHNAELLPPTRTTSEPPLYKRLGNMVIPPLQSSFSFLSPGGTSEEDEFPFEDSNNSTPREDEDDKATGFGELKPLNQFFNMLTATSVQSGHCFLKQLRSGAGSPEPGLHRARSPSLAYGVFDYESDEDTESDTADDSSVKENGPQNDSKVTIVKDADSESKPMEEPAPRISTSDTRSSYNEDLHSDTSADTFHDAASRRSGLLDFEKVAPTAEFETIQENSFESSALDDTSDQRDSKLSVFQQSILDNLDPQLIHEGVLIVHNEKKDHSTTENKDSELYKRKVRDLRLKIADKLTLVFQLKDNEYFCGNYNAWLAKDVLLQGHIYLTHKNLLFFSFLPKRYSHDNMTDSDGFQSVDDSDDVVQAGTLSMRNPNFTDQILSGPMAHRFWVILRSETLSVYSSAVDLYFPTVVIDLKDCIHAEIEDSKANREMGITSPRCGFGKYSETATPRSYDSTVDEESDISSFVAQDQKPEENPLTGGVWIRLQTKKRTFRFCADNQFSARKWVNNITKVVFSLQNSNARNEVLFKVPIQSIDRIEKNILFDVANNSETDEEPTISVTIIYTVNQKRLSTTRMKERLSKQSKGDDEQTVNSNQRKIHLLFFQHGAKFMEAISCFMSADQDATSDVQTMFSRGSDPSSKISMESESIINRAKTPKRKVSRVDSRSDQSISTLCDNDTNQLLEQLFVGSYGSTPTLTPTETNNESSTIKKIGKSLASPSRLFSRSRSSSFADEKRLEFVESGGLDVAWQLPRKLSLTGLKNINFSFEASQKQVSEAAARYNELSDAETPDEYVKSKSEILSSHTAMPTPLNFGEASEYEQAMPKKSLGLKTFSKSIKAISGMSGIWSSNPTHYEKKDNEDPYYEKDSSFREISNKNFLNHFSFNMEKRLVASYTTHLQRSLPVYGKLYLGDSDLCFRSLLPGVSTKMILPLKDLENCYKEKGIKLKYSGLVLVIRGQDKLLLEFGSQKSRDDCEAMILRQLEILHGRENWRPEPHQWGPKYIPDEVQAPGIEWKKDMEMMHIRAKQARRRRINQARIQMFEEKLNAAIGMDVPLLLEDSPLIKTEVRPSTSFKFTLLTIGSRGDVQPYLALAKGLQEEGHDVTIATHSEFKEWIEGHNVKFREIAGNPTELMALMVRHGSMSVTFIKEASSKFRSWITELLSSSWDACQGTDILIESPSAMGGVHIAEALGIPYMRAFTMPWTRTRAYPHAFIVPDQKKGGSYNYLTHVMFETLFWKGISGQVNRWRQNELGLPRTSLLKLQQTKIPFLYNISPSIFPPSVDFPDWVKVTGYWFLNEGGSNFNPPPELLEFLSLAKENGKKVVYIGFGSIVVKNAKSLTKAIVEAVQEADIYCILNKGWSDRLSDSDDKAEKEKPEIDLPPEVFNSGAVPHDWLFPRIDAAVHHGGSGTTGATLRAGLPTIIKPFFGDQFFYASRVEQMGVGLSLKKLNSKSLTKALNTVTSDFKMIEKCRSISERINHEDGVSAALEAIYSELEYAKHLSISRRASGYEASGSQTPVVYEQSDESDESGYDDEDESEETETDEESTDNEDITEIENVPHLDYVQNHRKSSESSSEEDVAIATTTTND

SEQ ID NO: 7785 - protein, 885 aa, Fusarium fujikuroi
MDLSRIKSHGLGHVAIDDSDTDNGPSGNVIDDGRVKVQFHDTPQALAQWCEHLKEAFAADGADSEHLLPPKPSKPRRTSTVAFLPGVEKPAEGPRLNIAIHIVGSRGDVQPFIPIAQLLMKPPYGHRVRICTHASFKEFVEAQGVEFFNIGGDPEALMAYMVKNPGLLPNKDSLKEGDVGKRRKEMMEIISGTWRSCIEAGDGMGDPVKAATVENVDDLFLADVIIANPPSMGHIHCAQKLNIPLHMVFTMPWSPTKAFPHPLAAMSYGDADAKVANYLSFMMMELLTWQGLGDLINKFRRQTLHLDPISPMWGFQLLSRLRIPYSYLWSQTLISKPSDWDEHLNITGFSFLPLASSYTPPKDLLDFLEAGPPPIYIGFGSIVVKNPQALTNMILKAVELAGVRAIVSKGWGGVGVGEVPDNVYLIGNCPHDWLFQRVSAVVHHGGAGTTAAGIAAGRPTVIVPFFGDQPFWGQMMARAGAGPVSVPYKELTAEILADSIKFALKPEVQEVAKDMAIQIGEEDGAGGTAQDIQDRLDIDSLRCDICPDRLANWLDRKTGAHLSGFAVGCLIDAGLLQSQNLKLLRHRHWYVDEGAEYPLVGAVAAVSGFASAIGTATSDYAERLRNSPGRGKTRRSSVDDAQEEVLTDPEEAKTGEARLRKGPRGANQKDMEILARKMATKTLNGAEPVFLTPKLRRPVTGLHQKHKKAWRAHEGGRNGRVFYVTRVTGKYVGDLAAASARAPVAFFYNVANGFHNAPSNFWNVEVRRRDEITGLGSGLKVAGKEFVLGFYDAFSGIVTKPYEDTKARGIKGLGRGLLRGGFGVCGNLGAGYALKGLEKEMMKHTTTRLKAELLLIRLRQGHQDWQRATEGEREEVIRRWRALKL

SEQ ID NO: 7786 - protein, 1572 aa, Sporisorium graminicola
MSTTRPTSPPEHSTPLANEGSTHASPAAVATDLDPFIVDDDAHHDIHPPSPPPPAQIPHNLDTPPFPTSPRLDPWSPRDYSTISSLAGSRELGRPALEPTTKIFAEGAATSALANESSTGFVQPATVGDDPLIDPVAVDVSFHAEPQGLMQMLSLVGSTFFDADTDGYTEDDAEDLEEAQQPDKAAPELLQDCQQQEVAQAESTLEGAQPDPTDHVEYPFDRTVKGRLHSLARDDGSDDGSTPQGSRSPLDASVLTIGPNHSKRTSLTQSDIISSSRDSAATRAARKPFNLRSQLHNVATASMFASTSNVVNRGRDLDAVQLRRGSSPFDSDPTDGQDVPVAVQRVSLRLPSQAGHLPSRSLDLLIRPYLESQPPGELAADKSAMHRDRLLRQLKDVFQLDATEMLLLAQPCWLFRSLLLQGHLYLTSGHVCFYAYLPSRDEKTIKTSWLRKRTRRTHRFSKHWASLKAGKLSWFDSDRDPYFPQGHIDLRKVSAIERSNAHKDRFKVTTPARRFTFLTEDEQSRDAWVEALQKETFRAQNQGESVRISIPLETVMNVDTTLSVDGTEMVCITVVDEAGDFSVDEYYFLHLTKPTAFIAELGSLLEQMGTGSVASLHSGEAALHLSRLSIRDSTGATHAAAISRKSLEEVPTLPKVRVPAQPDEEAAHPAEATESNIPKAGPTDPVPVEVPRRGSSGNPASATFTASSAVAVPISIRKDSQEGSTADAILSTTPRATTLNRLSMESTHTYPPSPSESDPPTSFDQAQREAERGWAIPDWLKSAPAKVLGRGSGGKSATVLQSKAPPTEASVRRRRKVLEKWSDDKGDDLSRGESSNTDNEEELLSHSIHSAQSNYSMLDADDEEAESADHASVAAEFRDTFGIGEDESLVGHAHAYLYRVLPVAGRLFVAEHHLAFRSSGIAAKTVGRTLMLVPLQDVISAAKHVAFRPGHHGLVINISGHEELFIEISSVHRRDELLSLIEYQLELIRGGRGSIQSREAVTRERSHALVLRDLSERINDAPSTASMTSSADSSMLSQAGSRLGSRSNSVSQMGAGSSLLSFSPATLLTFTMLTIGSRGDVQPYIALAKGLQADGHRVRIATHGEFGDWILGHGIEFSEIGGDPAELMRICVENGTFTVSFLREGVTRFRDWLDDLLASAWRACQGSDVIIECPSAIAGIHVAEALQVPYFRAFTMPWTRTRAYPHAFAVPNKKAGGNYNYMSYVIFDQMFWRASSFQINRWRKTLLGLKPTSFDKLEQHKVPFIYNFSPSLVPRPLDWFEWIHVTGFWFLDNPDNRGSKAWEPPGELVAFIRGARERGRKLVYIGWGSIVVPDAAAMTRCVLQAVRKSGVCAILSKGWSDRLSTDPAGRASEAVVNEDVFQVSSVPHDWLFPQIDAACHHGGAGTLGASLRAGLPTVVKPYFGDQFFWGQQIESLGVGSCVRQLTADSLAAALITATTNVKQIQRARKLGEQIRSEDGIGNAIKAIYRDLDYARSRVKRDTRIEVKEAKARQGDTAMPRPPAKEAEGRQSAEEDEDGDDDGGNTSDEWSDIGGAASPNPHRPVPNSSVVLS

SEQ ID NO: 7787 - protein, 1311 aa, Aspergillus flavus
MIAAVGSKSDFHARFDESSDSEGEAEGQTQKQPGKASLSNKKKFPLSPTLKPQSTLEGRGRRHRRSISDNKLLRSLKPSPKSSKGTETTVQTEPPTSDEMSPLASPRRARSATPRAAPILSRMLEAEALLDKKQSADQPSSSTKGETDGTSEQSCASPLSLRLKEMFGFEMPEKVLMEYACSLLQNILLQGYMYVTEGHICFYAYLPRKSAVTIRSGYLHKRGRKNPKYNRYWFSLKGDVLSYYTDPSSLYFPSGHVDLRYGISASLTEQKDKDKEVRDFQVTTDQRTYYFRADSSASAKEWVKALQKVIFRAHNEGDSVKISFPIESIIDIEESPITDLAETFKIRVVESDESYAIDEYYFSFFESGRDAYNFVKGLISEGPMKTSQLLPPPSEQTSPATRARGPRNRWSLNSDLSQSRGNGIFKTQRKRSASTGQTNSGPDGIGMSPRQRDLSDSFVNSFEQATDASAVLQSMIDTTESASQILNRSDVFQSPTIHTLRQRHPSGDRTGRRLSDGTARSTHPNAADANRNGQEMQYASSDSDQGTQHPSKVNSSAPTLNELVKAGAYPLQRAAGFAEYLRSRSRQMSNLLASESMGYIEKVSGMWAGGRRHYGETEGVLPDDQDVDPEDKEDGVKHGDRFRAHFALPSTERLQATYYAYLHRVLPLYGKIYISQKKLCFRSLIPGTRTKLILPLKDIENVEKEKGFRFGYQGLVIIIRGHEELFFEFNTADARDDCAVTVHQSLESMRFLVESGLLAEQEKDEIESAQAEHRMLQEARLDGAGEHDSHASVNESSELHPIFDDPRASIINFKPSESLRITCLTIGSRGDVQPYIALCKGLLAEGHKPKIATHAEFEPWVRQHGIDFAPVDGDPAELMRICVENGMFTYSFLKEASTKFRGWIDDLLSSAWASCQDSDLLIESPSAMAGIHIAEALRIPYFRAFTMPWSRTRAYPHAFAVPENKMGGAYNYITYVMFDTVFWKAIAGQVNRWRKKQLGLKATTLDKMQPNKVPFLYNYSPSVVAPPLDYPDWIRITGYWFLSEGGNWTPPTDLLDFIHRARSDGKKIVYIGFGSIVVSDPSALTRTVVESVLKADVRCILSKGWSDRLGDPASAKVEIPLPPEIFQIQAAPHDWLFSQIDAAAHHGGAGTTGASLRAGVPTIVKPFFGDQFFFGTRVEDLGVGICMKKLNVSVFSRALWEATHSERMIVKARELGAQIRSENGVDTAIQAIYRDLEYAKTLARQRSIVSSTPFSPTPSAKTTAEQEEDDVDDSEEWTFVGDDTEIDVSRRLRDRAVSDADMLPEPVTSAS

SEQ ID NO: 7788 - protein, 1468 aa, Capronia epimyces
MATLDTPPKKGGGRKLQKRNPNLNRLSSSRLPPRLRLGPDAQDDVTAPSRGKNTPAAYMNQSIFSMIAAAGSRTDFNSRFNDSSESEDEIVAEEQTPAADKLYPATSDHVQDVAAKETDASSDHTSKRLSGSRLAQPLPRLSARALKRKDKDQPPLQSPSPESDGTSRSSRSNPRDAPILSRILTAKAEFQESVDADVQVPSSTEGKRPRKRAESSPQTLLAARLMEIFGFEQPETVVAEYPCWLLQSVLLQGYLYITQQHICFYAYLPKKSHTVAKNGYLAKKGRSTSKYKRYWFSLKGDVFSYYSDPSNLYFPSGNIDLTYGISATLSTERGKPKESRDFSVITDHRTYHFRADSPSSAKEWVQALQKTIFRSHNDGDSVKISLPVDNIIDFEDSPVVDFAETVKIRVIESEDSYAIDEAISNYAQYFFSFFSFGQDVLHVLGELLTEAPPRRTSADVFSPTRRAEDASSPMSRYALPRQPSDGEPRSPRSHSTPPLKDNIRATLLPFHVGGDGRMSPRRSGGSSRGNSPSRSSGDYGRASFERGRRSGSTSRLDASTSRRKNRSPLARHHESEDSYVQSVDKETDSSTAPLSPRVEAQMSASQILTRSDVFHPHAVVRMETLASMSTEPTRKSSDGGTILSSSPQRETSSPMAMRGTADATGSYPRDVRETTHNEVVFSESDNGKKPFKDDPPPSLQDLVKAGSYPLQRAGAFAYYLKNRSVSMRKLLAEESMSYLEKVSGMWAGHRKHYGENEGIVPDDRGIDPEDEEANVGHGDRFRAHFALPPTEKLQATYFGFLHRVLPLYGKIYISNRKFCFRSLLPGTRTKLVLPLKDIENVDKEKGFRFGYHGLVLVIRGYEELFFEFSSAEHRDDCTITLLHSLETVRYMAESGVLGQHDEDDAEIAKQEHRMLQEARRNSGGEPQLVLPDTAETIYSHDEVSAVPFDDPRASIINFRPTAPMRITCLTIGSRGDVQPYIALCKGLLAEGHRPRIATHAEFGPWVQKHGIDFRPVDGDPAELMRICVENGMFTYSFLREASAKFRSWIDQLLTSAWHACQDSDLLIESPSAMAGIHIAEALGIPYFRAFTMPWTRTRAYPHAFAVPEHKIGGAYNYYSYVMFDNVFWKAIAGQVNRWRKKELALRSTNLDKMQPNKVPFLYNFSPHVVVPPLDYSDWVRVTGYWFLDEAHDWQPPEELTAFIKKARDDQKKLVYIGFGSIVVSDPAALTKTVVDSVMKADVRCILSKGWSDRLGDPAAIKTEVPLPMEILQIKSAPHDWLFRQMDAAVHHGGAGTTGASLRAGVPTVIKPFFGDQFFFGSRVEDLGVGICLKKVNVSLFSRALWEATHSERMIVKARLLGEQIRKENGVQTAIQAIYRDLEYARSLIKPRPTGPGASASAAGDADDGGEIEENWTFIGEESDPDLQRRMHDWESPRRGRGLGVGIEGAAGLRAIQGVEPVRSSGVQR

SEQ ID NO: 7789 - protein, 1278 aa, Lachancea lanzarotensis
MAKKQVSGPGSVILASADGAGRRSSTSQRRWMRSLSPVGKLYHSSASLMHFPGRTVGNERASPAVSDGEEAATIDSGNRDLEPDLACPRGMAKSIVGLLTTASVYAGMRDMEQAAEICEDDPLADDDGEDSTVSKSEEDQNQDQDQDQNQDQNQDQEQEQNDNNEAKMETMRRTSPQMDRNDSSDSLDATIDLDSLADTATHVSKKDTLFEISVEPNHDAMSVLSTSSGSRQQKIYRKLLSRFNLKEEDDEFVLRQSCWLLKDLLIQGHIILTSRHLLFFAFLPKSTGTAKMSGSLSTFSGGLRGRWSRYWAVLKDHTLSLYNSRQDLYFPLLTIDLRYASRIELDNRGHGATGTFRIRTEAKTYKFRADSHFSSRSWSSALKKQLFATHNSDNDSMSVRIPLANILDVEEQMVVAQSVTLRIRVLESPTSFAVDDYFFMFLGKSEMNLRQAINTQLSKMDKPPLKSSDINRLSIPVSELNDDESELLEKTQRGRSDSSSRKIMKRVLSPVSRVRRPSFPAHVHLSHKYPQRALSLLKPKNESESRSSSFKDEASSRVSHTTPQETVELASPQQLQVSPDEISDSDESVQVSEENKMASSKLASWTPRPIKNMGSMWGAHPVHYRQGPADIFPDDDQYLASVKEQSVASKRFKSHFSLKDDEILRAAYYTHLNKNIPVYGKLYVGTSVICFRSLIPGNKTKMILPIEDLENCYKERGFRFGYFGLVLVIHGHEELFFEFSLQSSRDDAEYVTLKEIDSAKLDVGSPVSTIDGISQKLRSTDISAEQKATDAGKLRLFEDKINAEGYDLPMMVEESPFFKTSISPKKSYRFGLLTIGSRGDVQPYIALAKGLLREGHRVTIISHSEFGEWVKSYGIKFREIAGNPAELMSLMVQHGSMNVGLLREASSKFRDWISELLGTSWQACQNLDILIESPSAMAGIHIAEALQIPYFRAFTMPWTRTRAYPHAFIVPDQKRGGNYNFFTHVLFENIFWKGIGGQVNKWRIETLGLKKTNLMLMQQNKVPFLYNISPAVFPPSVDFSEWIKVTGYWFLDGKDDFKPPQELANFIAKARKEGKKLVYIGFGSIVINNPKKMTKAVVDAVLEADVYCILNKGWSDRLDGDSTGNDTEETFPSCIYSSGSVPHDWLFPQIDAAVHHGGSGTTGATLRAGLPTIIKPFFGDQFFYAGRVEDIGAGINLKKLNSKTLSRALKEVTTSSRMSHKAQQIQQEISREDGVETAISCIYSELEYAKSLVQAKNKDKQDDVKDLGSPEENSWFLV

SEQ ID NO: 7790 - protein, 1285 aa, Unknown
  Description of Unknown: fungal sp. No.11243 sequence
MAATPAPQWPQPDRIPYRRKQEAGGIPVPDRFTDEDQEDTQGEEEGTGSQRADLPFMHQSVFGVIAAAHSKEDFGNILDQDGSGDDSQDEANSSRPRPADAASGEPTNSPAPKVKHKKKLSEHRLIRSLPGIRSKSSNDKTTSAAASPATSPLLDQQPSSRDAPIMSQMLHARAHAENLESSTATLTAKPIASASASTTSLKATGKVPMALPDALKDIFQFDQPEEVISEYPCWYLANVLLQGYIGKTNPHFRRYWFTLKGTIFSYFADPSAPYFPSGNIDLRYGISADVVLDKDKKTTNFFSVTTDKRTYHFKADSETSAKEWVRQLQKVIFRSHNDGDSVKISLPIDNILDVEENPVIDFAETIKIRVIDNDETFAVDEYFFSFFSFGKDAINVLKIMTQDTAAAKALAEQRPATTLDLAPSDSSAEISKSKRSPANLTVHDIYENVRATVAIRRSSIEEEGRGTDSLRRGNAGETARRSTEGDRTRKSFDRNQRSPSAASGVSFNSSRPVSEIPRVGDLSKSQASSMTADESGAPSRATDLLRDQGKRVSNLLGSSPRGYYEKVYGMWAGGKKHYADADGLQGEDYVYDPDEESDTAQAEARFRDYFALPPTEKLVATYFAHILRVLPLYGKIYIGSTKLCFRSLLPGTRTKLVIPFKDILNVDKEKGFRFGYSGMVAVIRGHEEIFFEFNTAGLRDDCTVTVLKALETLKFSGRPSTVSEEEKAEADRAASEHARLQEARQDGYIEHDLALPSNFDDIERGVPPILFDDPQASVLEFKPTEPLNITCLTIGSRGDVQPYIALCKGLLEEGHKPRIATHAEFGPWILKHGIDFAPVDGDPAELMRICVENGMFTPSFLYEANSKFRGFLDTLLTTAWTACQGSDVLIESPSAMAGIHIAEALGIPYFRAFTMPWTRTRAYPHAFAVPNHKMGGAYNYMTYVLFDNVFWQSTAGQINRWRRKVLKLRPTNLDRMQPNKVPFLYNFSPSVVVPPLDFSDWIRVTGYWFLDEATTWTPPDALVSFIRKAREDEVPLVYIGFGSMVVSDSRAMTQSIVKAVEKADVRCILSKGWSDRLDAASRTEPDVPLPDCIHSISSAPHDWLFGQIDAAVHHGGAGTTGASLRAGVPTIVKPFFGDQFFFGARVHDLGVGACIRKISENVLGKALWIATHDARMREKARILGEQIRSEDGVGTAIKAIYRDLEYARTLVRRKLVPLKSPQPNDDADDDDDDDVDGDGQRQGTADQDSDNHEAAAESWTMVGQDSEGSDTEHHHRGGAVAGLEP

SEQ ID NO: 7791 - protein, 1389 aa, Yamadazyma tenuis
MSSPPSQDQPQAHSPSAAPQDYFTAKAPSSGNQSPQIHQDDTDLENSSVPAYICRSLSDRIIPSLQASIGQIYSSVATPTETETDAKLDTNSETGSEPVGSTPRTLDTINMQSLTSFQSSMVRNFEILKKDGVLVRFTEDSNSSTPIDDVLSTNLKLNIADRLQKVFSIQDDDIFYANFNGWLVRDVFLQGHIYLTKNCILFFAFLPSKFSSPPDSQSDGEFRKQDDSSVYIQTGALATKTKKYGEILGTVFTNRSWAILRPETLSIYSSPTDLYFPTLVIDLRTCVHAEILEKYQPKTENASNVSKPVPVGSPTDTPSGILSPRETLSRGNSDDLLNDDEELNKMLALEAEDNKESNNGGVWFKITTTKRSYKFQTDSIYSARQWVNNITKIIFQLHNSNSKNEVLVKIPLDNITSFNRSSLFGTSDIDVDDSEEVPAVFSLTYSTGTDNVLHQNKKIHKKFTEKAKQQLNLSGTEDLHFVFFSKAQEFDDTISKIVHDREDGNSESSSISNSEKFIQKMKLKRFQGPKEEHETELSKVDIPFSTLSPHGNPSAILDQMLEYNRAMLHSRTPSAASPSDVSSRSSESTSPMNLNLPRQLSVTGLKKLNMFFDTSKRDVGVVADRYGNIQITGPNGNEPVSEKSVLPSPLNLADPSEYVDQDYPKKDNKLKAFSKSIKAITNVSSVWNAYPFHYIQMNDKDPFYVTDEAARNLGQRRLRSHFSLGETNTLAASYFCHIQRALPVYGKLYVGNENICFRSLLPGVSTKMILPLRDVENCFKERGTKITFSGLVIVVKGYEKLFVEFSSHKSRDDCLDVMLEGLHQLHGSETWEPSAHEWGENYHEQSNKLRLSEDGEDTNQSLAPSDETLKQASMRIESARMKMFEDRFSVAAGLQVPIVLEDSPFFKTEVRPNTSYHFVLLTIGSRGDVQPYIALAKGLMEEGHRVTIATHSEFKDWIVSYDIKFREIAGDPTELMSLMVSHGSMSVAFIKEASSKFKGWINDLLKTAWVACQGADILIESPSAMAGIHIAEALGIPYMRAFTMPWTRTRAYSHAFILPDQKKGNSYNYLTHVMFETVFWRGISSQVNRWRVETLNIPKTSLFKLQQYKVPFLYNVSQTVLPPAVDFPDWVKVTGYWFLDEGTGNKYKPPPELIEFMRQATKDQKKIVYVGFGSIVVDDAKSLTKAVVESVLDADVRCILNKGWSDRHGDKEGEDSKEVEVELPFEIYNSGAIPHDWLFPRIDAAVHHGGSGTTGATLRSGLPTVIKPFFGDQFFYASRVEEIGAGIALRKLNSKSLSKALKLATTDFKMIERAKKVCEQIRHEHGVLGAIEAIYSELEYARSLIVNKQLANENYGMLGSRTGYTVNNSEDEDSSSIEIDISSKSETDF

SEQ ID NO: 7792 - protein, 1071 aa, Melampsora larici-
MTSSQPQSPPSSAVSSVEPPNSIASAAGLHDPILPYGLNGLGSTASMVGILKAAALNPYEDLDDGLADDSELWSPNTTQQPRAMLSDEESDDDDNTEEGLLFTPTRPVHPSSSLIRGASTLDYPSRHHLDGLARQLIERQTHCAEIAIQKTHTPLIENSSPSTRTLKLLEEPTSILNDILPEADRPSSPDRESELTPDDRLRLLEEQFGTWSGLDASGQPESESWIGQVAGVLYRSVIVKGVILLTDRRLCYIAYLPITDKGKLIRSGTATYKSGARFSKRQRRWVELRTDSITDYRSSTKLFRPLSSLHLSDIKRILPISPEEPRTLSFRLMDDHVIHLEFDTAESTALWHHDFVQALFSLKTHFSNQIKLSLPLRRIRKLHREVFENIAKMMTFELDFGVLSPFYTDSSEALSRGVVEEPIDEKDHSRIKMAYLLSHDPFDENIIDAIVRAKMEISSSQTESQPSTAHRTPLPVLEVLEPRDLESENVDDPTKLTESASYESTDKNMSDLAKGFVKAFGLEAHQKLYICPCSLVRTLPSFGNMSISNDYFCFWRPAVVIGQDLKLRIPLKDIAEAKECSAFGFTRSGLSIEIAGAADIRLDFSSQASRDETVKVINLAVDRVREAGARAARRQSSLPTHNLLCPPDESLPPSPLTARQRQSLPAIIGFVQPEPTTRPYRITCMTIGSRGDVQPYISLAKRLMQDGHIVTIASHPEYRSWVESFGILYKDLGGDPGALMKLSVDHAFFSPGFFKEGLGKFRQWLDDLFMEAWNACTESKAEILIESPSTFSGIHIAEALRIPYFRAFTMTWTSTSTYPQAFASSIDLGPTYNLLSYSLFDSLIWRAMSGQVNRWRKNTLGIPPTTLEKMQSYKVPFLYNFSSAVVPKPLDWRDHINVTGYWFLDQSQGNYVPPPDLTAFIASARADGQPLIYVGFGSITVPDAAAVTKAIYAAVVQAGVRAIVAKGWSERTQTTSADSVPIEVPPEVHVLSSIPHDWLFPQIDAACHHGGAGTTGISLRFGLPTLIHPFFGDQMFWADRVTRLGAGMRVDHLTTSCLSEAFVKATKDRVL

SEQ ID NO: 7793 - protein, 1456 aa, Ustilaginoidea virens
MDNFPALPPGADAAERDAPPSTSAEISVSQRRVSRKLKKKRLLDPAAPLLELPDPLRHSDSDDEDSPNDPASRRGRAVSVNMNQSIFGLIAAAGSRVDFNTRFDDGSSDEEDGETPRISDGPQDLSQTVILPARSRDERRGHKKRLSGHRLLKSLSTLPTLPKRKSKKRETSQLSAPSLDSSDDGKETTSPSPTAAAHLDGQDYRLAPVMSRMLQARAEVASRPSSDLDRRSGDSPGTDDAGESSALAKRLMEIFEFDEPELVIEGNNVVAKSGYLSKSGKRNPKYHRYWFRLKSDVLSYYRDSTNLYFPHGQIDLRFGISANIVDKDKDGLHFNVVTSHRTYNFRADSAPSAKEWVKSLQRVIFRSHNDGDSVKISLPIDNIIDIEETQMMEFSETCKIRVIDNDETYAIDEYFFSFFNFGKEAINVLKILVDGASSNSRTPGKLVAEHEQRYRGLEQQQKQRHGEQAVRQTSPRPSGLSDRQELHVEEMRTTKLPEAVKATLSPMPPHSTGPSPRASMDCSSRPSADAFRGMRRRSQDVSAMMREQSPRRSFSGHRRTQSTRRVDEKKPKHGVESPDSNTHSSTEDPSFSNLAISVATEDPTASQILQGSEVFHSPTMRKSIDASSQSTDAIGKDAKGGSSESCVPGASIPMKHAATTGHISQLGYHGKSAQQQQQQQQQQQPERSSTPTLQSISKMSAYPLQRAGAFADYLNKTGKRMSTLLATESMGYVEKVSGMWKGGRKHYGEPAGLRPDEDELEEDSDGKVQTSMDRFRAHFALPESEKLQATYFGCIIRVLPLYGKIYISDRSFCFRSLLPGTRTKLILPLKDIETVHKEKGFRLGYSGLTIVIRGHEELFFEFSQVDVRDDCTITVLQSLETSRYLRESGILHQEELEEQQVAMAERDALKSARREEFPAHEMAPPHDAESQPNAPTILMDETDGSFINFKPPQPMRITCLTIGSRGDVQPYIALCKGLLAEGHKPRIATHAEFQDWIESHGIEFRMVEGDPGELMRLCIENGTFTLSFLREANSAFRGWLDQLLDSAYAACEGSELLIESPSAMAGIHVAEKLGIPYFRAFTMPWTRTRAYPHAFIMPEHKMGGAYNYMTYVMFDNIFWKATAQQVNRWRNKTLGLPNTSLEKMQPNKVPFLYNFSPSVVAPPLDFSDWIRVTGYWFLDEGAEYEPPRELSDFIQRARRDGKKLVYVGFGSIIVNDPAKMTQEVIDAVLKADVRCILSKGWSDRISPRDDDASASAAAAAAASQPRPDEPPMPPEIFVIKAAPHDWLFGQIDAAAHHGGSGTTGASLRAGLPTIIRPFFGDQFFFASRVEDLGVGVGLRRWGANSFGRALWQATRNERMIVKARVLGEHIRKDRGVETAIQNIYRDLEYAKSLIKRKAGPHDEPDAEEDDTEESWTFVGSDEHDPDAVTKKLSEGLGRPAPGKTPPAALGSKVLKG

SEQ ID NO: 7794 - protein, 424 aa, Calothrix sp.
MRIAIIALGSRGDVQPYIALGRGLKQAGYTVRLATHENFEELVSSHDLEFYPVQGNVQEIIETKEMRELLEKGNFLAITSHTAKLAQDAAIHWANDGLVACQGMDLLLVGVGGQNIALALAEKLDLPLVQAYVFPFTPTKAFPSVLFPQFISKLGGFFNRLSHHLTRQLMWQGFRSADRLMREKVLGLKAAPFWGLYNCDRLHQYPILYGFSPSVIPKPSDWHNTHVTGYWFLDSAPGWNPPSALMEFLESGSTPLYIGFGSMGNRNPEETVDLILSALALSKQRAIMFAGWGGLRKQNLPSTVFLVDSVPHSWLFPRVAAVVHHGGAGTTAAGLQAGVPSIIIPFFGDQGFWGEHVAKLGVGAKPIPRKQLTAEKLAEAIQQVMTDKAMRQRAANLGARIQAEEGIAGAVAVIEEIRKNVTSS

SEQ ID NO: 7795 - protein, 1198 aa, Saccharomyces cerevisiae
MPITQIISASDSEAGPKPSISLVPDKPSEPETSPRHHRLSRSLSKFKRWRGRSNSSLSMGSSEQQELQDSPNEARSDDDENGYNNDNADDLAKSKYMMKSIAGLLTTASVYAGMNNAQEMNVLSQVDSEESDSSDSFQENIGRNEVKSKKENLKTKSHPEVPRLDKRKPTLFDFSITREKLSKDNVAKLRQRFCLDEQEPFLNDFPAWLLKDVLVQGHIFITTKHFLFFAYLPKNPRSVKMSGNLNIRTKLIRSTRYWCVLKNHLFSMYTSSTELYFPVLTIDLREVQKIETQKHTLNGSATKTFKLYTDESTFKFNADSEFSAKSWVNALKKEQFAAQNSENNSISLKIPLPNIIEIDDQPIVNKALTLRLRALESSQTYAIDDFMFVFMDGSGSQVKESLGEQLAILQKSGVNTLYYDIPAKKSKSSFGKETPATAEQKNNGEDSKYLNVPTSAVPSSENGKKSRFRFRERSNSWFRRAKPLEDSQVEDVEEIYKDAANDIDSSVHSTIHIHEQEDSQEQTVAWKPSHLKNFAEMWAAKPIHYRNKFIPFQKDDTYLIKETEEVSANERFRYHFKFNKEKSLISTYYTYLNRNVPVYGKIYVSNDTVCFRSLLPGSNTYMVLPLVDVETCYKEKGFRFGYFVLVIVIHGHEELFFEFSTEVARDDIERILLKLLDNIYASSAEGSNISSASLGDVQHNPDSAKLKLFEDKINAEGFEVPLMIDENPHYKTSIKPNKSYKFGLLTIGSRGDVQPYIALGKGLIKEGHQVVIITHSEFRDFVESHGIQFEEIAGNPVELMSLMVENESMNVKMLREASSKFRGWIDALLQTSWEVCNRRKFDILIESPSAMVGIHITEALQIPYFRAFTMPWTRTRAYPHAFIVPDQKRGGNYNYLTHVLFENVFWKGISGQVNKWRVETLGLGKTNLFLLQQNNVPFLYNVSPTIFPPSIDFSEWVRVTGYWFLDDKSTFKPPAELQEFISEARSKGKKLVYIGFGSIVVSNAKEMTEALVESVMEADVYCILNKGWSERLGDKAAKKTEVDLPRNILNIGNVPHDWLFPQVDAAVHHGGSGTTGASLRAGLPTVIKPFFGDQFFYAGRVEDIGVGIALKKLNAQTLADALKVATTNKIMKDRAGLIKKKISKEDGIKTAISAIYNELEYARSVTLSRVKTPRKKEETVDATKLTPAETTDEGWTMI

SEQ ID NO: 7796 - protein, 1189 aa, Talaromyces islandicus
MASENPPDLHPEDDAPGNELSRLPTQVDLSVGEVPRPAFSNVYGQMDLTGAGLNTQAAITADGRVNIDINERTPWLHSIFKLPALKHPKHEALLPYVPPSLEREGDQRLPRLNIVIHVVGSRGDVQPFIALGQVLKRVHGHRVRLATHPSFEQFVRENGLEFFSIGGDPAKLMAFMVKNPGLMPGIDALKNGDIRQRRFEIAEIISGCWRSCFEAGDGTGVPVSDADVDLRNFQGSSPPFVADAIIANPPSFAHIHCAEKLGIPLHMMFTMPWSPTQAFPHPLASISQSNADVGISNYVTYALVEMLTWQGLGDIINRFREKSLGLEPISILWAPSMIPRMRVPYTYCWSPALIPKPNDWSDHIDISGFYFLPLASDYTPPADLEEFLNAGPQPIYIGFGSIVVDDPNEMTRMIFDAVRLTGQRALVSKGWGGLGAEELDIPEGVYMIGNCPHDWLFQRVSCIVHHGGAGTTAAGIALGRPSVVIPFFGDQPFWGAMIARAGAGPDPIPYKQLNAEKLAAAINKALEPTTLEKAGELGAKIRGEKGTEEGALSFQRQLKADTMRCSLAPSRVAVFRLKRTRIKLSAFAFNVLNTEGLVELEDVKLYRPKEYLTEADPCDPVIGGGAALLGNIEGLIMGFADLSHDIRRGFNIGGSRPGSPRIGSKRSSREGSPASNTEEVVEDGQLAKSSSETSSRAIQRFALGTSRKGSDASEKTSLRGRSMTTNSQTPSTRTNATSTTVTTTETAPAQKIDLDGVISAGKSAAKIFNMGFRAPADFTMAVAKGFHNAPLIYNDDTVRESPKVTGFKSGLKAAGMEFGYGFYDGISGLAKQPVQGAKKEGAAGAIKGFSKGIGGLILKPASGIWGLTGYTLSGIYKEVQKRFGESVENYIMASRCAQGVCDAASATAEERDGVLRHWKYLEAEFVRKKAARHSQSKFNDRTVGPRASTMALESPSAEIHPREVDETASTREPGRSAADRARRRQALRDLFRGRSNSSPSRLARSNPAALPPAYEEAILHSVHETSKGDATEDEMIERALRASMVELQAAEAAGEEEQRAYERALDASIREAERVLAENKKSMLHSPSGSSSQIKSPALDVFDQEARRPQPPPLPPRAMETDGTSDPDLQAALLQSHASYEESLQREQREKSELDMVMDYVKRQSLAELEYERQRREASGVEDTTNDLR

SEQ ID NO: 7797 - protein, 1776 aa, Phellinidium pouzarii
MRRFVAVILVIFAHVGQINTTTVPRGLGMIKVNMSGYGIALQNSIGDPVQGLYATNASTSIGEGTGLRQIYQFGLYSYCAYIDKVQGSCSNSSAAFQLDPYEVVLADMFSNYSSLTKGFIPTNLTFTNSHYLSEFSNAAYYLLLLGSICAALAMIIGIPKKTYTYLLSTLFAILGTGLLFVGVVIWTVLVNKTESINRATVTTSGSDSEVTPLGIIVSAGASLWLFWASFVCLFLSIMPYLVSLEVGAAFSATARKMSDLPPPSLQNPIKGTTINTSPEALGLEHASNESPLSQSRVRINSNSKNAIKRTVEHTAARIGSRVLNSGSRWDSNVSQQGRLSSSLTVADPRRFRTLRKGKGRERESLENMSEENLSSSTRTSLTSRSTSVRQASVSVLDDSPFIRPLSPSPTSTPPRRPSLDAFQTFGSMRAGTQTLIQAIQAMPWTDEPEGDDEAIPPTAYNSDTSDEEQMELPLASSIHTIHRPIARSRRHDSYLASKSPNGKGKRQGYFSPVQSSDEERGDVTDEDEDFERTPIESRHLYRPDEFPMHEEDISAVDAGADKMDRLAHVRRVKMTRSASLATVRIKRRTMLAEKLKDVFGLNEINEVVAELPCWLLRSILLQGYMYLTNSHLCFFAHLPSREDQVLKSGSLNKKTQRTKRWVKHWFVLKNDVLSWYQSSADPYFPHGVVDLRYAISCDPTQEKGFRIRTNQKVVTLMADSVPSREEWVKAIRKVIFKAQNVGESVKIAIPYSVVVDVDKSSAMDFSETIEVKVIDLEEKVADDSNDSYFFAYFHNISAALDQIRDAVKTYKPCSPNAINISEVVHDTTGVKHASPNGSPFDRTISLPTEQQASRAGYGLKLAALLRPFQSDTSSVTPAQNYAQPKTQENASVLRQSGVLVSSPPAPSAKTLHPGLTNLTTAMDTSESSASQRLLSEAAGIASVRKIDASHTYPPPPSPPSELIPIATRDNANSWGVPAWLRSSRRVFATPSASISGLSIGQKGVSEIISNVASSSRAGDRGPLDFGFSILETRDAAEPGAAEKFRTTFAFDEKEQLLGYFQGYLFRLLPTYGRLFISTNFFCFKSSGPLASRTRMQLPIRDILSLEKTTAFRFGHVGLVIIIKGHEELFFEFGSADRRAAFVTLLEHQIEETQLRLNTGSARSPSDAKRDALLLEELEPASLFGDEEPKPPPESMTDSLPAVMFTSTSSTFLTFKPLQPLHFTCLTIGTRGDVQPYIALAKGLMADGHRVRIATHGEFKEWVESYGIEFGYVGGDPAELMRICVENGMFTVSFLKESMQKFRGWIDDLLKTSWEACHGTDVLIESPSAMAGIHIAEALKIPYYRAFTMTWTRTRAYPHAFAVPEHKMGGGYNYMVGSHFSHRFVLEKSIPDSFNYQSYVMFDQVFWRATAGQINRWRKNTLHLPSTNLDKLEPHKVPFLYNFSPTVVPPPLDWPEWIRITGNWFLDDAEVSATKWSPPNDLVDFIDSAHEAGKKVVYIGFGSIVVSDPDAMTRCVIEAILQSGVHAILSKGWSDRLQVKKGTDVSEPETPLPPQIYPIKSIPHDWLFKRIEAACHHGGAGTTGASLRAGIPTIIKPFFGDQFFWGDRVEALGIGSCVRKLTVESLAEALAVATTDEKQIAKAKLVGERIRTENGVATAIESIYRDLEYARSLIKSSNVVEEEEDATIGEEQRMHTSTHSATFSSPRSSADSYLESGQEAQSEDWSVISDTDDRRSSRHSNDLRTQSPISKRNSLAAAVLSVLPEALQLSSPKNTRI

SEQ ID NO: 7798 - protein, 409 aa, Streptomyces antibioticus
MTAGSRGDVAPFTGLGHGLLRAGHEVTLVTHGSFEPLVAGSGLGFHSLPVDPRTVLESERGKGLHRSATGPGKLLRAVTMARALASTMADDLVAAARAADVLLLSASLAPLGHTIGEGLSLPTLGLSLQPVASTREFAPPMLGGGSWGGLGNRAAGHGVSMAIEHVFSSVVPEVRTRLGLGQVRSVTALRRRERRNWPVQHGFSPLVVARPRDWRPGLDIAGYWWPYDVSTELPSEVRDFLDAGPPPVFVGLGSATVPGPERLSADIVRALRRAGLRGVFQQGWAGLAADGEDMLTVGEIAHSALFPHMAAVVHHAGAGTTGAGLRAGVPAVPVPIQFDAGFWSQRLVSLGVAPTTVPLRRLTTDRLASALRTITRDAGYRERARELGARIRKEDGVAPVLEAVNCLRG

SEQ ID NO: 7799 - protein, 408 aa, Actinokineospora spheciospongiae
MRVTILTVGSRGDVEPFLALSRGLLAAGHDPVIATLAEFEPMVTGAGIPFALLPGNSRAVLAGPEGQALMAERNPFRLIERMRAVIGPALLEAHPAAEEACAGADLVVHHTMAVFGITIAERLGVPSVAAHLFPNSPTREFPMVAMPSAVPAALNRLTWRIAESLPWRAFRPLLDTRRAVLGMPPLPRRPLSRWPTGAPARLYGFSPAVVPPPADWRADDHVTGYWFTEPGAYTPPQELVDFLAAGPPPVYLGFGSASGGSPGETAELLLSAARANGLRAVLHTGWAGLSATAEDTLTIDDVPHWWLFPRVRAAVHHGGAGTTAAALRAGIPSVVVPFFADQFFWGRQVVELSVGAVTATRDRVTGPELAEALRTALTRAPRARELAAELAAEDGVATAVEVLESVVR

SEQ ID NO: 7800 - protein, 1227 aa, Galerina marginata
MSQSKQQSTEDSPFIRPPSPPLRPSLQNSFRGDGSMRAGTQTLIQALQALPWMNSDNEEDGPNEIGSADSDSDEEEKPNLKRLSSSIHTIHRPLARSHRVNIPLPSKLSYIQPPQEEDILEDTLSPSDEELENDFEEAPRPDDVLPHPQRPGQVISANASRAPFNAMRERAGSMATVRLHRRARLAEKLKEVYDLDEIKEKCPAGSSVLSGYMYLTNSYLCFFAHMPSREDQILKSGSLNKKAQRTKRWIKHWFVLKNDALSWYQSSSDPYFPHGIIDLRYAISCDASGERGFRLRTNSRTIVLSADSVPSREEWVKAIRKVIFKAQNMGDSVKIAVPYSAILDVERSTAMDFSETIEVKVVDKEDHFAVDSYFFAYFHSLPGALEQIRDAVRSYRSSNGAETGTPPIVLDTTFPRSPLTAERPNSIATTTSESPSAKTMSGFRLSSIFRPFSDTAVRGASAPTVSDLQSDDYTHVSRKVDSSSFIPITTSPKPMTSPLPPHDLSASPTLYSTQSLPPPEHTYPPSTSASTIYPNHSSLSRESTSSWAVGVPSWLKTPRRVFGVSTGTEPAPTLNSTPVKEIYSSSAVSSPGPISRPSGLGDMAFSVLETPDMLPEQEMADKFRAAFAYDEKESLLGYFPGYIYRLLPVFGKLYISTNYFCFKSSGPLAARTRMTLPIRDILASEKSKATRFGHHGLIIIVKGHEELFFEFGAEDKRDAFVQLLDRQMEDVRKRLASGDVELPSSGQRDALILEEFEARNSASGESDPLPPTDNMADSLPAVMFTSASSTFLTFKPKKSMHFTFLTIGSRGDVQPYIALAKGLMVDGHKCRIATHGEFREWIESHGIEFGYVGGDPAELMRICIENGTFTVSFLKEGLLKFRGWLDDLLKTSWEACQGTDVLVESPSAMGGYHIAEALAIPYYRAFTMTWTRTRAYPHAFAVPERKMGGSYNYMSYVMFDQVFWRAQAGQINRWRRNFLHLGPTSLDKMEPHKIPFLYNFSPHVVPPPLDWPEWIRVTGYWFLEDADVSAKKWIPPATLVHFIDNAHKTGRKVVYIGFGSIVVPDPKAMTHCVIDAVLRSGVHAILSKGWSDRLQVKTSEATEPEEPLPPEIYPISSVPHDWLFQRIDAACHHGGAGTTGASLRAGIPTVIRPFFGDQFFWADRVEALGVGTGVRKLTASNLSDALAAATSDSKQIARAKIIGEQIRGVMPSLLYKKHSDYWTRRME

SEQ ID NO: 7801 - protein, 420 aa, Vibrio coralliilyticus
MNILIVTIGSRGDVEPFIALGQALLARGHAVHLCAALRFKSLIERYGLIHHPLSDDLFKLADGGVMEKLGNPMSAVKTIYQLTKSAKSINHQMMADSIAAGFAAQPDLVIFHPKSLAAVSLADKLGVPAIMALLQPMIVPTKAFPPAGLPDLGGCLNRVSYRLIDMGYRQYIHELNKLRATLLHLEPLEKNSGVFHRSDRQEVPRLHAFSQHLVSRPTDWPENAVLTGNWSLSIDQDDYKPPKALIQFLESGQAPIYIGFGSMAGRDPKQLTQTIIHSVSKAKLRAVIATGWGGLEAVPENMLIIDSAPHNWLFPRVAAVVHHGGAGTTMAGLKAGKPSLICPFFADQPFWGKTIYNNNLGPKPIKQKHLNVDTLTPALVDLTTNKSYQRYAAKLEKQLNIEDGLVNAIHWLETHGYLSR

SEQ ID NO: 7802 - protein, 404 aa, Streptomyces sp.
MRIVIVTAGSRGDVAPFTGLGRRLLDAGHQVAVAAHPSFAALVGGCGLDHRPVPGDPQGLIRDLARAASRKEAQALTKAYADGLADGVAEAVAGRADLLLTAFGPAPLSRTAGEAFGVPVIGTYLAPSFATGQFPLPNARSIDELGPAGNLAAGRDVLKRAEGVFAGAVTRLRARLGLPAGASPAPVDVRPVFHGFSPLVVPRPEDWPSWAEVAGYWWPARPDGWHPPAELVDFLQAGPPPVFIGFGSMAAGQGERLSELVAAAVKRTGVRAVVQTGWADLNGCGADVLAIGDIPHDWLFPRTAAVVHHAGAGTTAAGLRAGVPAVPVPVMADQPFWASRLYALGVAPRPVPFQELTADSLSAAITTCLSEPSHRRRAAELARQIAAEDGTAPLLVHIGSESAG

SEQ ID NO: 7803 - protein, 581 aa, Pyricularia grisea
ERFRQHFALPESEKLVATYFGHMIRVLPLYGKIYISDRSFCFRSLLPGTRTKLILPLKDIENGHKEKGFRFGYSGLVVVIKGHEELFFEFGQAEVRDDCAITLLQQLESSRYLQESGMLGQDEKEDAENAVAERDALQSARQEERPTHEIPLPKQTSVVSDAPTILFDDPKASFLNFKPPNPLRITCLTIGSRGDVQPYIALAKGLLREGHEVRIATHAEFEPWIRSHGIDFRKVEGDPGELMQLCIENGTFTWQFLKVAASKFRGWLDELLSSCWQACQGSDLLIESPSAMAGIHIAEALQIPYFRAFTMPWTRTRAYPHAFVMPEHKMGGAYNYVTYVMFDNMFWKMTAQQINRWRNVELGIPNTSLEKMQPNKVPFLYNFSPYVVPPPLDYSDWIRVTGYWFLDEGTPRKAAAEIEDGDGSEEKSTDQQGEGKNAASGSNWTPPPELADFIEQARADKKKLVYVGFGSIIVNDPVKLTQEVIDAVIKSDVRCILSKGWSDRMSTGSNATDPKPAEDGEKVETDQQPVEKKEEPKLPPEILQIKSAPHDWLFAQVDAVAHHGGSGTTGASLRAGVPTII

SEQ ID NO: 7804 - protein, 404 aa, Streptomyces netropsis
MRIVIVTAGSRGDVAPFTGLGRSLLDAGHQVAVAAHPSFAALVDGCGLDHRPVPGDPQGLVRDWSRAASPQEARALTRAYADGLADGVTEAVAGGADLLLTAFGPAPLSRAAGEAFGVPVIGTYLAPAFATGAFPLPNARNDDGLGPEGNLAAGRDVLRRAEGLFAGTVARLRARLGLPADGPSAPGDIRPVFHGFSPLVVPRPEDWPPGVEVSGYWWPARPDGWHPPAELVDFLQAGPPPVFIGFGSMAVGQGERLSELVATAVERAGVRAVVQAGWAELSGCGADVLAIGDVPHDWLFPRTAAVVHHAGAGTTAAGLRAAVPALPVPVMADQPFWASRLYRLGVAPRPLPFKDLTAEALGDAITACLSEPAHRRRAAELARQIAAEDGAASLLAHIGSERAG

SEQ ID NO: 7805 - protein, 749 aa, Aspergillus nidulans
MLSYPSSLIPGGGRVREDGRVEVNLDSKACRAVAELIGTSPAEVDHPLGPPPPYEEVQPIGTQQLLGIRFNIVIQVVGSRGDVQPFIALGKELQKHGHRIRLATHDIFATFVRNSGLEFYPIGGNPAELMAYMVKNPGLIPQLHSLRAGDVQKKREMVAEMLDGCWRSCIADDPVTKTPFVAEAIIANPPSFAHIHCAQALGIPLHLMFTMPWSSTRAFPHPLANLKYSDTSQEMANYFSYGIVEWLTWQGLGDVINSWRSKLDLEPVPATEGPMLTQTLKIPFTYCWSPALMAKPADWPAHVDVCGFFFRDAPDYKPPQSLDAFLQNGPPPVYIGFGSIVIEDPKKFTAIILDAVRSLGVRAIISRGWSKLGGEPSESIYYIDDCPHEWLFQHVCAVVHHGGAGTTACGLRNGRPTAIIPFFGDQPFWGNLVAVSGAGPKPIPYRDVTTTKLAEVIEFCLQPQIQHAAQTIASRMQYEDGVKTAVDSFHRNLPLDKMRCDLLPNRSAAWTCKTPSLRLSKLAAQILVEHLRVDRKALQFYETNPVVIENRRWDPVTGATSAAIGTGTDMVKSTADIFLKPYQEYQDLRRGRPRSGDRPDDNAYIPPAPRSLSTPPPDTLTQQPPDITSNPSTFHTTSTIATASAKSIGRVLTTYFKGTMVDIPLATAEGLRAVPRLYGEDVKEHKPVKDWKSGMVVGCTSFSQGMVDGLTGIVMQPYRGAKEEGALGAVKGLAKGTVGGAASLGSGLR

SEQ ID NO: 7806 - protein, 1316 aa, Phytophthora nicotianae
  MOD_RES (219)..(219): Any amino acid
  MOD_RES (252)..(252): Any amino acid
  MOD_RES (446)..(446): Any amino acid
  MOD_RES (655)..(655): Any amino acid
  MOD_RES (826)..(826): Any amino acid
  MOD_RES (874)..(874): Any amino acid
  MOD_RES (1149)..(1149): Any amino acid
MSHGVEFYPLGGDPKELAAYMVKTGGHLIPTKIETLTKDVPRNKEMIKEIVHSTWPAVSAPDPDGGGAGVPGKPFQAQAIIANPVSYGHIHVAERLGVPLHIMFPQPWVPTMAFPHPLANMPYTDELKKTNYLSYKMVDLLMWQGTEGLINDFRTKVLKLRKIRNGDGGRDLLLDLHIPHAFMWSPELVPKPADWGDLYDVIGTVTLNGGSNSSYTPSXELETFLGRDGGPIFVGFGSMVLADPLATTKMIXEAAQQAGVRVLIQSSWSDMAGDLDIPDNVFFIGNCPHDWLMPRVCAVVHHGGAGTTAAGLLAGKPTFIVPFFGDQPFWGHAVVKAGVGVKPCPIAQLTTEKLREAFVGLMDPALRARALNLRDVMRREDGAGEAVRSFYRHLPTQEMFCDLDHERIATRWSVRDRLKLCDRCAFIVSERPGNASKKMVSYHCVXYTARGPDSTLAGASSGTGAFFHEFAGAYTGLVREPVKGYSKNGVAGGAIGTLKGVGGFLVRPTLGLVHFTDRVVTGHINAHREEGEQKHSSILDRRFMSVIGVQRGLANSHTPSTEANCVDSVIFASQKKRKKMLHSINNQAGKYRARYQAALNLRREQSARLTGDNPLFPGSSKSPKHPSCTQTSLWHNQPGIKLCKARLTSHGSVDXESRVPNIEDDFIDKDSIAQWREFAAFQHGKALQAQRTNSNIRPLVPSMNICLAAIGTWDNGIKQFAAIGLKLAAHGHRVRLAANECFRPKIVALGLEFYPLAGAPDSVQDCAQLIHNAQLNTEAGRSGFGALQAFRELIYSLWPAAYGSDPHGSGPNKPGEHFRADALLWXPMLLGHIHVAQRLGIPLQCASLDPLSPTFEFPHVLSSLAGREAAAMMXPRYSNLLSHGVVDAALNHGSVADVLTQFRSFIGLTSGLDRPNPLVQWEVPHMYLYNPVMLPKPLDWGEELSVTGHVTLQDGLETQEIPRALTEFASSSSNEPVIYFGVSTRDLPFGAFEDLVRKIELAAQQLRMRIIVQDQEVGSTARSPYRSEFVYLVDTDLPYAQLFAHVTATIHWGEPDVLAEGLMAGKPAAVCGSHPSQLFIARLCQRVGVGIAPIDPTTCTIESLLSSFQQLLQPVIRTNAQGLVRSFDPDRAVDVAVDSFYSHLPLEAXVCDVDPRKLARVFDSQHTVKLSLEAYLAVQPVRDESKGFVPYKPLHYDGFCPPVFSICGNPGEIPRDVKPSRKLDAIGMALEVLNAQDERRSSELSQHSSDSSSGSIVAQVVDTEVFWSSTEQEEAVRKATNVAYERLVKPDGLRKRDKLAHMFSGKPKTGELQAVG

SEQ ID NO: 7807 - protein, 1296 aa, Aspergillus niger
MFASVLPERLRNDNDDDDDSQVDFSAPPGGMGPREGHMQYMHQSIFGMIAAVGSRSGFHARYDESSDSDGEDESRARKDAENLSATAGALPKRSGNESPRLSPKPQSPTPERGRRHRRTISDHKLLRPFKLNSKQNKGQEPAVQSEPQTGDEMSRASTPKRPRSVTPRAAPVLSRMVEARALLDTEDSTKGAPSTTEEIRDEGPTQKSASALSLRLKEMFGFEAPEKVLVEYACSFLQSMLLQGYMYVTEGHVCFYAYLPRKSTVAIKSGYVYKRGRKNPKYNRYWFSLKGDVLSYYADPSKLYFPSGHVDLRYGISASLAEPKDKGREVKDFQVTTDQRTYYFRADSSSSAKEWVKALQKVIFRTHNDKGSVKISFPIENIIDIEESPMVDFAETFKIRVVESEETYAIDEYYFTSFNYGQDAFNFLKGLVADTPMKRSQQTLSPQPEQTSRSRRTRGSQNRWSITSATSQSRGIGKSGNRRRSASTGQFSFGHDALKKTVRRHSDETARSVHTTRNGPEIQYAVSESDRDTQTPSGLHPSTPALNELVRAGVYPLQRAAGFAEYLKTRSKQMSNLLASESMGYLEKVSGMWAGGGKHYGESENILPDDQAVDPEDLEAGCKDGDRFREHFALPPSEKLQASYFAWLHRMIPLYGKIYISQKKLCFRSLMPGTRTKMILPLKDVENVDKEKGFNFGRHGLVVVIRGHEELFFEFGTADTRDDCAVTLHKGLESTKFLMASGLLAECEEKDESESATAEHRLLQEARLDITGMHSSRSAMAASNELHPIFDDPRASIINFKPTESLRITCLTIGSRGDVQPYIALCKGLLAEGHRPKIATHAEFEPWVRKHGIDFALVDGDPAELMRICVENGMFTYSFFKEATAKFRGWIDDLLSSAWKACQDTDLLIESPSAMAGIHIAEALRIPYFRAFTMPWSRTRAYPHAFAVPEHKMGGAYNYITYVMFDNVFWKSVAGQVNRWRKKELGLKATGLDKMQPNKVPFLYNYSPTVVPPPLDYPDWIRITGYWFLSEGSDWTPPAELVDFIQRARKDEKKVVYIGFGSIVVSDPSALTRTVIESVQKADVRCILSKGWSDRLGDPASAKSEVPLPPEIYQIQSAPHDWLFSHIDAAAHHGGAGTTGASLRAGVPTIVKPFFGDQFFFGTRVEDLGVGICLKKLNVTMFSRALWEATHDERMIVKAHKLGAQIRSVSWIQLGDVDLLTIDQEDGVDTAIQAIYRDLEYAKTLAQARSNVSSTPFSPTPSAKTVAEQEADEDVPEEEWTIVEDDTELEMRPTVA

SEQ ID NO: 7808 - protein, 716 aa, Rhizoctonia solani
MHPNRRDSAFSHTGGSQRYNSYHELPVPTSSAASSVHNSPYSATRSFESLAQATIQPPPPPLYTRHDHGSQAGPSEPRPSFHSHSSSTSEFVAHDQDLSVLPGYTQLDAKTAVSEDGRLTISFGNRMSKAFPDSYGAPVHEVGIDETGFRCAPRMNINIMIVGSRGDVQPYLALGKQLQQYGHEVRLSTHETFRKMVKDAGLKFYNIGGDPHELMSYMVRNPGLIPGLESLRNGDIGKKQKMVAEILEGCFASCFAPDLGAGEETGFAADAIISNPPTFAHIHCAEALGIPLLLSFTMPWCPTASFPHPLVNIKQSENTEPKMANYYSYSLVEMMTWQGLGRTINKFRMKRLGLDYLATASAVGMIERCAVPWTYCLSPALVPKPGDWMSHIDVVGFYFLDLASDYSPPQNLVEFLKAGEPPVYIGFGSIVLQNPQEMTKAILSGIAQAGVRAIVSPGWGGLDEDLIRSAGPHVFALGNVPHDWLFQHVSAVCHHGGAGTTAIGLKCGKPTIIVPFFGDQPWWATQIARRGAGPPPLDSKKLTAESFAVALRIALSPATMRAAEAVGETIRRENGVQNGVDSFHKHMPLLNMRCELDPTRVAVWYSPTHGMRLSAFAAQGILGAAAGVGKGTLSATTKPLAGVLQFISQPLEGTAKDVRSLFRKEVGKERIAARYAEGVLAVRKSSQKEKEMLVQTFIEHRGRMKMAGKGKDRAVW

SEQ ID NO: 7809 - protein, 222 aa, Oryza sativa
MEAEVASALVGTCMPCNQFVLSYQIVDSMIWLGIRDMINEFRKKKLKLRPVTYLSGAQGSGNDIPHGYIWSLHLVPKPKDWGPKIDVVGFCFLDLASNYVPPEPLVKWLEAGDKPIYVGFGSLPVQDPAKMTEVIVKALEITGQRGIINKGWGGLGTLAEPKDFVYLLDNCPHDWLFLQCKAVVHHGGAGTTAAGLKAACPTTIVPFFGDQPFWETECMLEG

SEQ ID NO: 7810 - protein, 825 aa, Rhizoctonia solani
MIVDDHLDKSTTRSTSHRSPSMKSSPHSFEAFTQTTSDQAPLPAYSRRTQSGESVLERGAPSIEGQYERDASGNHGKSLRSSKLDAEAAFQDDGRLQISFGDRWSKSLPRNYAEPVNEVGIDEVGFQDAPPMSVNIMIVGSRGDVQPYLALGQRLQSYGHTVRLSTHETFRKLVKDAGLRFFNIGGDPHELMSYMVRNPGLIPGFESMWNGDIGKKQAMVAEMLDRCYLSCYEADEGSPGERGFVADAIISNPPTFAHIHCAEAFGIPLLMSFTMPWCATASFPHPLVNIKQSGSHEPKALNYYSYTLVDMLTWQGLGHAINKFRSKTLGLDYLSTASAVSMIERCGIPWTYCLSPALVPKPQDWLSHIDVVGFYFLDLAKDYDPPADLVEFLCSGEPPIYVGFGSIVLQDPKEMTKTILEGIAQAGVRAIVSPGWGGLDETMIKAAGPHIFALGNVPHDWLFQYVSAVCHHGGAGTTAIGLKCGKPTIVVPFFGDQPWWAAQLAQRGAGPAPLDSRNLSSGGFAAAIRFALSPDTVLGAQEIGRMINEEDGTTNGVNSFHKHLPLLNMRCDLDPKRVAVWYSPTHKLRLSAFSAQVLADRGEIDMNKLKLHRSREYNTHALPTDPISGTALPMLRVVNGVVHGFIKIGSTRPDKGLVKMATATAGGLQTTLQGMTEGLTNVPKLYGSEVRESKKVTGVVSGLVEGSKGFAYGFYDGITDLVREPVRGYKEKGALGAVTGFGTGALNLAMKPGAGMFQIVSKPFEGGVKDIRGLFHKDISQHKIGVRHSEGILAVKQASQRDQDAVVQAFAARISRERKGKGKKT

SEQ ID NO: 7811 - protein, 428 aa, Unknown
  Description of Unknown: Pelagibacterium halotolerans B2 sequence
MTKRIAMATLGTQGDVQPYVALARAMIAQGYSVVIGTTDDFESMVTGYGIEFWSLGPSMQEFVKQSQFERAMNQNLLVNAPALLRQGQKIVDRAARSAWDMAQGADCIMLNMNTSFSIDIAEALDIPAIVAALQPLNSTSEFPLCIYYGPTFGKTINRLTYSTMTVQQIYYNLPRNKLRRELMGLGPRKNGGFFKDTDGTPLWTLNAYSEIISPRPRDWPKTSIVTGYWMLPDNSGWQPSEEFKTFLDKGPLPIYVGFGSMPWGADRNTDILREALTMWNGRVVVGRGWGGIKPDDLPADRVYVIDRAPHDQLFKYVKAVVHHGGAGTTASGLMLGKPTFIVPQMVDQPYWGGRVHEMGCGPKPVRRRKLTAEALADALSQLDSNPGFARNAEKIGEQLRAEDGTGKAIKVIERVMANYQPRSERKLA

SEQ ID NO: 7812 - protein, 1462 aa, Clohesyomyces aquaticus
MASEERSRDRIGRKLTKKRKEPRRVSLDIPERFKDGDDAHEDVTAPKTKDGMSMNQSIFSIIARAGQQSQTNLGTMREVDSGDSDDERRPTADFHSLDGAARLSRLSTANDFKAPTQNDGEAKGSGSKHRRALSENKLLRSLPKLKMSGRKDNRRDSIATADRMSSSQILPPRPSADESAGASQDEQLASQKLRITPGQEIHVEKRRHSISHRSRHGSTAGGSKGKGAVTLASRLQQIFEFEALEEVISEYPCWLLQSILLQGYMYITQRHICFYAYIPKKHHDVSKTGYLSKRGRSKYNRYWFILRGDVLSYYTSPSDLYFPRNRINLQYAISAEALEPKDKTKDETIFVVNTDERIYQFKADSVASAKEWVRSIQKVIFRTHNEGNSVKISLPIQNVLEIEESTVLDFADTVKVRVIDNDETFAIDEYFFSFFSNGQDALNVLRIMINDNDHHHEPSNRTGLTAKSPANASGSGQAEHAISSETPKDAPHIKENVRATLSPLPAPYVGRVSGESGRSSLDANRRSFDVRRSMDLSRSIRRSSQEVRRSFSGSRRDGPSRSRPGDRSPLSAKPQDSSESATNSFDPGTESSVAVQSMDESNASASQILGRSDVFRGPAIHTSGVPASDNSARQSQDTTRSSGMGKTHLTSPRISNRNHRGSSGNAHSPLGAPDVEDDSENLQTNAPLSTSSSALQDLASYPLQKASGLAGFLRTRSKRMGNLLATESMGYYEKVSGMLAGGRKHYNTMDSLEPDDRVHGVEEDEDAAKAAEHFREHFAFSETEQLQSSFFASLQRVLPNYGKIYISGRYFCFRSLMPTSKTKIILPMRDIENVNKEKGFRMGYHGLAVVIRGHEELFFEFSKAEFRDECAITILRILESTKYIEENESSSSDLDSDDEAAKAEHDLLQAARDGPQTTVQPFPADISQITRGADHDRIPLIFDDPLASIIDFKPPESLTIVCLTIGSRGDVQPYIALCKDLLKEGHKPRIATHAEFEPWVRGHGIDFAPVDGNPAELMRICVEHGMFTFNFLKEANSKFRGWLDDVCSSSWKACQGADVLIESPSAMAGIHIAEALQIPYFRAFTMPWTRTRAYPHAFFVSEKKMGGAYNSFTYVTFDKIFWTAISGQMNMWRRRELGLQNISQNKMQANSRPFLYNFSPNVVPPPLDWPDWIRVTGYWFLDEGDRYEPPADLLAFMQKARDDGKKLVYVGFGSIVIDDPARLTKTVVDSIIKADVRCVLSKGWSDRLASKDASKPEIPLPPEIFQIQSAPHDWLFKQMDAAVHHGGSGTTGASLRAGIPTVIKPFFGDQFFFAQRVEDLGVGVWLKRVNTTMLSRAIWEAANSYRYIIKAKVLGQKIRQENGTQVAIQTIYRELDRAKSLIKKHSKRDEDTDELDEDWTMIEDYDEADIPQPFEITQAVDGVNTVAVDTPRMGGGSLALGSMVLRGASTSRRASGSPFRDE

SEQ ID NO: 7813 - protein, 418 aa, Thermomonospora curvata
MPRKIVLYALGSRGDIQPCVALGRALNARGHRVRVIAAARYADLIASAGLDPAPLSVDPADLLNTEEGQRLLAGGRNPVAFLGGLRRVLGPLAERLLGEILTAARGADLVLAPSAGWLGEHIGEHLGIPSAVIHYQPSHPTGAFPHPLLPQARLLGRWGNRVSFQAVDLLAWVLIRHFVNPWRRGQLHLPPASLLGLPRRVYRERPVLCCFSSAVVPRPRDWPSHVHLTGYWFLDEPEYRPSEELAAFLEAGPPPVYVGFGSMVPADPQSAHRLIHDAIHLAGVRAVVMGDPKSGLTSGEDVLVVEDVPHSWLFPRMAAVVHHGGAGTTAAGLRAGVPTVVCPFFGDQPYWGERVAALRAGPEPIPFRKLTVRGLAEAIRQAMHDPVIRLGAEHIGRRLSAEDGTAAACEVIESLLPG

SEQ ID NO: 7814 - protein, 1047 aa, Claviceps purpurea
MASVNHQAAPASSGNSTTQQDAADTTLASTSQFPGKLDIPSQSVASSNMRKQSAPDPTASHDGSLRRPLVLERWQTATYDDGREHAESIPSRAWIPLDGNMGVVGGGYDTDSSSSDEQDIEPGAGDRDATKVRSKLSNCTSAHSAKPHRKKEGHKSKTKHKHRPNTERTRSDGRLRITVHETAHTGYLANALGAVAHSMRPKPLPTTRPKVRRGISTPQPRLNIVIMVVGSRGDVQPFLRIGKYLKDEFGHRVRIATHPIFRELVEKDSGLEFFSVGGDPAELMAFMVKNPGMIPTLETVKAGEIGKRRDVMAEMFDGFWRSCIHANEDERTNQSKPPSTVDGRHVFIADVIIANPPSFAHIHCAEALGIPLQLVFTFPYTPTHAFPHPLASIKQSNVDQGYANFMSYPLVEMMTWQGLGDLINDFRVQTLALDPVSTLWAPCANYRMHVPVTYLWSPGLVPKPEDWGEEIDVSGFVFLDMASSFKPPKALVDFLEAGEPPIYIGFGSIVVDDADRFTELIFEAIEKAGVRALVSRGWGGFGRDEAPDNVFMLDNTPHDWLFPRVKACVHHGGAGTAAIGLKCGLPTMIIPFFGDQYFWGTMVGKSGAGPDPVPYKHLTSDKLAEGIKYLLTEEAKDAAGKIAEDIEKDGDGAQNTVTTFQENLKLYGPPSMRCAILHSEVAVWQVKRHHVQLSARAAHVLVTSGQLAWKDLRLVRHTEWADFDGPGEPVTAVAETVKNTLRDIFSGIGSAPYRLGKTAKRRIKHKMKSSKDKKKKRESDEKGSQELTRQPSEVPGPDQYGRDLTMSVGKTVLAIATAPASIFVALAQGFHNAPRLYGDDTVRRPTRVSGVRSGLVASRREFVYGIYDAVTGLVYLPLRGARNEGAIGLLKGAGMGIAGLVLKPASAIVGPIGFSMQGVVKQIHRRHSPQNFIRRARMALGESQVQAMDTTAATALQEEVLTGWKVLQDLTRAIADEEHKRGLAGQIDKMTLDVAFLFLSVDRAKTCLADLRAGKSLDDITTGYKEWNTKSMDLGYRRNNTAPVQEK

SEQ ID NO: 7815 - protein, 1141 aa, Rickenella mellea
MSRTASLATVRLKRRAKLAEKLKDIFGLSAIEEVVAELPCWLLRSILLQGYMYLTNSHLCFFAHMPAREDQVLKSGSLNKKTQRTKRWVKHWFVLKNDVLSWYQSSSDPYFPHGVIDLRYAISCETVQEKGFRIRTNQKVVTLMADSAPSREEWVKAVRKVIFKAQNLGDSVKIAIPYTVITDVEKSSAMDFSETIEVKVSEKDDASTDSYFFAYFHNISLALDQIRDAVRTYKPTMHIPGAFEEVVHDTTTHKVLSPGSERAMVPPSIDSHRSSYSSKLASLLRFSSDSAAAHPTGVRTAPDSTNPSRSALSPSLSGTSLPPTSISVNDVGTIRPSDSYHTYPPAPSPVNISPVQSRESVISSWSVPVPSWLKVPSKRVFASPFSPSSSATEQGVQEVVSPLTPSLAFPSNNAGNASTELGYSVLETKDAAEPEMIEKFRTAFAFDEKEPLLGYFPGYLFRLLPTPGRLYVSTNFFCFKSSGPLATRTRMILPIRDILALENSKAYRFGHQGLVIIIKGHEELFFEFSSLERRSAFFNLLQRQLEEVRSRPVTGEVLKISEEKRDALVLEELEPSSILSDEDPRPPPETLTDSLPAVMFTSKSSTFLTFKPQKSLRFTFLTIGTRGDVQPYIALAKGLIADGHSCKIATHGEFKDWIESHGIEFGYVGGDPAELMRLCVENGMFTVSFLKEGVQKFRSWIDDLLKTAWEACQGTDVLIESPVAMGGIHIAEALKIPYFRAFTMTWTRTRAYPHAFAVPERKMGGGYNYMTYVMFDQVFWRGTAGQINRWRKHMLGLSSTSLDKLEPHKVPFLYNFSPTVVPPPLDWPEWIRVTGYWFLDDADGGSKKTWSPPDGIVEFIDKAHNAGRKVVYIGFGSIVVSDPDAMTRCVVEAIVKSGVHAILSKGWSDRLHVKKSADVFEPEIPLPPQIFPIQSIPHDWLFKRIDAACHHGGAGTTGASLRAGIPTIIKPFFGDQFFWADRVEALGIGSGVRKLTVDNLTEALAYATTDAKQIARAKLVGEQIRSENGVATAVEAIYRDLEYARSLIKPGRSDDSSTSDEDVKSPHEKQRKRRSSQSTPDRLHSSDSNHGAPSEDWSVISDQESSRFSASLDRSPSSKRNSLAAAVMSVLPTSKSRNATP

SEQ ID NO: 7816 - protein, 993 aa, Aspergillus luchuensis
MPHQDGPTADDWPDEHIAQQTTNSAGHGRTPRRAHYHEKGLNTGVRVMDDGRLDIKIRERKPWVSKIIKHLQQQPEPLREERKPSVCLVEDGKPPCALKLNIVIQVVGSRGDVQPFIALGKIIKSHGHRVRLATHLAFRESIEHSGLEFFDIGGDPAELMAFMVRNPGLMPHMSTLRSGAIPRRRREMKAIFSGCWRSCYETGDGTGMHHIPDDPWSETADYRTMPFVADAIIANPPSFVHLSCAEKLGIPLNMMFTMPWSATQSFPHPLATIRTKNTKPSAANFASYAIVEILMWEGLGDLINSFRKRELGLDPLDAIRAPSIAHRLRIPYTYLWSPALLPKPGDWGDNIDITGFSFLSTASDYTPPDDLANFLESGPPPIYVGFGSIVVDNPGSLTKKVFQAIRESGQRAVVSKGWGNLGADEDEIPENIFMIDKCPHDWLFQHVSCVIHHGGAGTTAAGLVLGRPTIIIPFFGDQPFWGSIVARAGAGPLPIPHKQLTAEKLTKAIKQALEPETLEKAKEIGRDMRKERGVQNAAASFYQHLDVQAMRCSICPNRPAVWWVKHSHIKLSTFAAAVLVETGLISPRNVVLYVLCSLSLVHPGSVTNGGCRYRSREYDTNRDPRGPLSAGAEVLYGIVSDFVTSIAEAPSGMRGIFSTTHERRLHHKHDWKKELHLSYLDKSSFHRHRRGRTETSLDSGVGADMIPNGDNQHSVTADQNQYENGERASNENSRGSIESDEAYHSAGEDINRDQAIPDRQQNVDGATNSPSGGESSSPHTSSSDTETFDTTDDDMGAELDLERTITRLRTREMSHTKEILAETSYHSAHLTLSLTKGFHNAPKLYHDTLVEDSPRVLGVRSGFRAAGTEFTHGFYNGITGLVTQPVVGIEKSGAKGLLTGIGKGVGGVFLKPTAGLWGLAGYPLEGMHKSLRNSLSKSKTKDILASRMQQGIEEMCAATTQERSAVIQKWHDLQRAGLGHMSEREHEHGHHGS

SEQ ID NO: 7817 - protein, 680 aa, Coccidioides immitis
MCHRVSVTYCVFSGQARSRRLLVSLSGQSVKKPVQNVTGDKRNIHSQSSFFRNFLARLTLFVVPCVLYLPPTISAYDSIMDNASVFYPFHVQYVLAAMRAACPARKRDADNGGSEAYEMSLMTPFFLTYRALDAAPAVAYYELDFRASNLSRRAARSLDDHCASSESLRITCLTIGSRGDVQPYIALCKGLLAEGHKPRIATHREFEPWVRQHGIDFAPVEGDPAELMRICVENGMFTYSFLKEASLKFRGWIDDLLSSAWSSCQGSDILIESPSAMAGIHIAEALRIPYFRAFTMPWTRTRAYPHAFAVPDHKMGGAYNYMTYVMFDNVFWKAIAGQVNRWRKRQLGLRGTNLDKMQPNKVPFLYNFSPSVVPPPMDYGDWIRVTGYWFLDEGSSWSPPEQLTAFIQKARNDRKRIVYIGFGSIVVSDPTALTKTVIESVLKADVRCVLSKGWSDRLGDPSSAKTEVPLPPEIYQITAAPHDWLFSQVDAVAHHGGAGTTGASLRAGVPTIIKPFFGDQFFFGTRVEDLGVGISLKKLNVNVFSRALWEATNSERMIVKAKLLGEKIRKENGVEKAIQALYRDLEYAKTLVRRRSIAAASPPLPVPLGSPKARHDWEDDLAGIEDTWTLVGHPDIDMELSQSSKGRESEFDLRASAALATGTLPDIVVDEDDGEEDVTR

SEQ ID NO: 7818 - protein, 599 aa, Vigna angularis
MADLPEDSRNSSHSSNDHGNGKGMEDSVHSAANGTSSSASDIPGKVLSKVTTMPVDISHGDKLESSSSKFRMERSKTERLRHLSPEDAAQIFDDKIPVQDKLKLLNRIATVKDDGTVEFDVPVDVEPEAIVTQSTKVNHVVDDSLDATDFHYIPPLNIVMLIVGTRGDVQPFIAIGKRLQDYGHRVRLATHSNFKEFVLTAGLEFYPLGGDPKILAGYMVKNKGFLPSGPSEIPIQRNQMKEIINSLLPACKEPDIDSGVPFKADAIIANPPAYGHTHVAEALKIPIHIFFTMPWTPTTEFPHPLSRVKQQAGYRLSYQIVDSLIWLGIRDMINDLRKKKLKLRPVTYLSGSQGSETEIPHAYIWSPHLVPKPKDWGPKIDVVGFCFLDLASNYEPPESLVKWLGDGDKPIYIGFGSLPVQEPKKMTEIIVDALETTGQRGIINKGWGGLGNLTEPKDSIYLLDSVPHDWLFLHCKAVVHHGGAGTTAAGLKAACPTTIVPFFGDQPFWGERVHARGVGPPPIPVDEFSLPKLVGAIEFMLDPKVKERAIELAKAMENEDGVTGAVKAFFKQLPQKKSDADAEPQPSSFFSLRRCFGCS

SEQ ID NO: 7819 - protein, 1518 aa, Valsa mali
MDFPEQLKQKDGEEDQEEDVLPVGLGHSNRPFMNLNQSIFGLIAAAGPKVDFHDRFEGHSSEDEAEDSDGRRRSKDGTTDPMAQTTILSKPSSKTNDNHRRKFSESKLMKSVPILSRLSTKSRSRKDAKKPVLQIQEESEPESPAWDAPTTSLTNDENRLAPVMSRMLEARAEVSARPSFDLERQSIDKGGEPLDLTNLTDLTQTGPSELSKRLQKIFEFDEPEELISEYPCWLLQGVLLQGYIYITCKHICFYAYLPKKAVSHVEPDPERTSLTIYQHEVTKSGYLSKSGKRNPKYNRFWFRLKGDVFSYFRDPSNLYFPHGQIDLRYGISASITDKDKDGVHFSVETDHRTYHFRADSAPSAKEWVKCLQRVIFRSHNDGDSVKISLPIANVIDIEEAQMLELADTCKIRVIDNDETYAIDEVRQMCGRDCQETSEMATNLWQYFFSFFSFGKEAIGILKILIEDYASRDHDDEAKKLDLPLSVGQNTAATATSSKQSSHSGDRSRPVTPPRARPSKLQGNVKATLSPMSPQSPTCLSPRASGEYLRKSYDAIQQFGRRSTDMNRIDFRRRSFSREGRSISRQGNSDRISGPDKHCSVDSYAESTEDPSIASLSAMTTSAEMEQSASQILRGSDVFHSPTVHRSASASRGKERERPRSPHRHISTGSLGAHFRSHHAATTGHVTDPSSGEHAEPTPSTPTLQTISKMGTYPLQRVGAFAEYLGRHSKRMGGLLATESIGYAGKVSGMWKGGQRHYDDPHALRTDDEDDDEEQVKIAEERFQAHFALPKSERLRATYFGYFMRVLPLYGKVYLSERNFCFRSLMPGTRTKLILPIRDIENVTKSSGFRLGYAGLVVVIRGHEELFFEFGDTALRDNLAVFLLKGIETAKSLRDFQGMDSEEQEEAEHAVAEHKALEKARHEEFPEHELTLPRQTASVSDGPTIIFDDPKASFINFKPEKSLRITCLTIGSRGDVQPYIALCKGLMADGHKAKIATHMEFKDWIEGHGIEFAPVEGDPGELMRLCIANGTFTVAFLREASSTMRTWLDGLLASSWRACKGSDVLIESPSAMAGIHIAEKLCIPYFRAFGMPWTRTRAYPQAFMMPERKMGGAYNIVTYILFDAVFWKATAHQINKWRNKTLGLPNTSLEKMQPNKVPFLYNFSQHVVPPPLDYSDWIRVTGYWFLNEGGENWTPPQDLVDFIDKARKDNKKLVYVGFGSIIMDNPSKFTREIITAVLKADVRCILSKGWSDRLDPKSAEAQEVGVAAIGGSDGKEGLMEIPLPPEIFSIKSAPHDWLFKQIDAAAHHGGSGTTGASLRAGIPTIVRPFFGDQFFFGGRVEDLGVGILLKKWGVNSFARALWEATHSERMIVKARVLGENIREENGVDTAIQCIYRDMEYAKSLIEKKAGKNAAAAERAATSGSDGDLDDDVEEESWTFIGDDAGPEDDGDVDIDAIMKRSQILAGFTDITRSQTLGNKSLMRSNTVLSIGSSSMPGQRSPVPSRSTSNDSAKLTDMGH

SEQ ID NO: 7820 - protein, 1836 aa, Sporothrix schenckii
MAPPRDPAAPTAASSTTPTPTPTQTPPLSTAPSDASNRNTNIDTTTSSTATLQAPPVAASASSSPGPSRTVAGTASPTTPSTNRNDHQRKSHSHSLRLSSRLSAQSPSTSALASALASSPTRLSNTSPRQSEDDAGRHKPKKLVKRRHDGGSQRTPKAMDFPERLKQSDDGGEEEVIRPVVSGNGAFYNMNQSVFNMLAAAGSNIDFNNRFGDHSSEEDDEDGGDAEGGDGDVAQRRHFSSDGAATTVLPAAGSQKKSGKKPAKDVSQSTIFTRNTSSTGKDGKDGKDSGRRSRFSDSKLMRSLPSLKQKLSSSKRRSSSGLSSKSSKHASAGGTSDSRILEEDEDADAEAESSHTPSSTQTRLPRGSGATSDVDVAVGSARGSNHSPSIQVTRAERSNSVRSIPVMSRMLEAKELASLRPSFDIDRDRKSSDKDKGDGVDVEDGGPSALSRKLMEIFEFDKPEEVIEEYPCWLLQSVLLQGYMYITSRHICFYAYLPKKANEVAKSGYLAKSGKRNPKYNRYWFRLKGDVFSYYRDAKNLYFPHGQIDLRYGISATVSDQDKDGVHFQVVTHHRTYFFRADSAASAKEWVKSLQRVIFRSHNDGDSVKISLPIENVIDIEENQAMVEFTETCKIRVIDNDETFAIDEYFFSFFDYGKDAVRVLKILIDANNVNSNDNNNNNNADSDNQSGQGTPSRAYGRRLDLPSAGQGMDDRVSQDSTGSVAFGAGQERMSMSKPPSKLQDSVRATLLSIPPTAASSPRASGEIPRTSFDALRSSFSPTRRSLDTSQVLRANPPRRSFSDRIKGAAGDTVQRKISQRSTSAAQPQSSDPQDSTDSFMQSSVEDPSQISFSNMAASSSDDPSASQILHGSDVFQSPTFDAGSPHSAGPPPSTSRPAAAAAAAAKPPPHHSATTGNIRKFKGAASDEAGENEEGLAQNLARLGTYPLQRAGAYAGWLNRQSRRMSTMLATESMGYVEKVSGMWKGGRQHYDDASLTPHADAGMPDGEPGMSVADAIVSNEHFREHFALPDTEKLEATYFGSIMRVLPLYGKIYVSQRYFCFRSLVPGTRTKLILPLKDIENVVKEKGFRYTYAGLVVVIRGHEELFFEFHQAELRDDCAITLLHLLDRFRSAKESGVLSDQDKADADVALAERDALKEAREEAAARMDDHAETPAESTAAAVATAKAVAASSEAKAERLNRKILRQSALMSEAPTILFDDPKASFLNFKPAKPLRITCLTIGSRGDVQPYIALGRGLLAEGHHVRIATHPEFEGWIRSHGLDYGRVAGDPGELMRICIENGTFTIQFLREANSKMRTWLDELLSTAWTACQGADLLIESPSAMAGIHIAEKLQIPYFRAFTMPWTRTRAYPHAFLMPERRMGGAYNQFSYAMFENIFWRATAGQVNRWRNKTLGLRNTSLEKLQINKVPFLYNFSPCVVPPPLDYSDWIRVTGYWFLDEGTNIKKANNNNNNNNNNNNNKSSSEPEGKEVAEAKEPAWTPPQDLLDFIAKARKDRKKIVYVGFGSIVVADPAKMTQEVIDAVHKADVRCILSKGWSDRLVAKKDDKTEAVAEAEAEAGAEAGAEAATGRVMHADPPEDVLPAEIFPIKSAPHDWLFAQIDAAAHHGGSGTTGASLRAGIPTIIRPFFGDQFFFGMRVEDLGVGLCLKKWGAMSFARALWEATNSERMIRKAAVLGEQIREENGVDTAIQSIYRDMEYAKSLVREKAAKSGMLRSGGGTERADRNDRGHGKHINADSDEEAYDDDDVDDDDEPEESWTFVGDDDPMQQSVILTPDAGRASGDDGVVQPASSGAGGSSGGYKALGSRILGIATAQKQ

SEQ ID NO: 7821 - protein, 435 aa, Xanthomonas fragariae
MVIAVLGTQGDVRPIVALGRGLQERGYPVRVLTSSNFEALIRANGLEFFPLSGDHWKLLQGNPEVANMHGSRRAVWNIWRTHLLMWARDWAAQGRAACADAGLIVGVGSVSFLAHSLGQAYGVPMVFAHLQPLTVSRHLPSMVAPNLRLPGLVSAALQHMARFACWYLIRPVLNELVRPALGLTAYPWNGPDRSAMRVLYGYSAHLCPRPPDWPKSVQICGFWQLPQPQWQPPAALQAFLKAGPPPLYIGFGSMTSSDSAQLTATVKAAVRLTGQRALLASGWGGLAAGEAAADDDAERFFHLEQAPHDWLFPRVAAAVHHGGAGTTGAALVAGVPSVVLPFGYDQPFWAHCLAQRGVAPPALERAGLQPETLADAMRQASAPAMRAAARALGQRIAEEDGVSRAVDQLEAWRLLEPAVAVTPVARIEQHAIAMG

SEQ ID NO: 7822 - protein, 1477 aa, Cryptococcus gattii
MSPPTSPTSCSLQPPFPPSATAPHPNPPSQHQQAVESLVNAAAQHVAPTCPPTSDESPQMADQAANSADDSLISNRQVPEQEQTETAIIPGTPLDEMEPAKDARAVQFSSSSPASTHEYQAETTARLNEPLTSSRAPSTGSSQIDEWRRPDFGASRDIGSEDDESDDGEDDDEFTDPAGGTSLAVYERKKRPQLPSTSHGSHPTHPIHFPFRQNAIARRARPPGTTELDYQYATSETSTRGMSETGSESSSEGEVPLPKGFVSPPNLIAPSAEGEATGPPDPKLISDRIKKEQQIADEEEQVEILRSSKEQEMRLGKEFVPGKSRGSAELNVDAALREGGSEGEDVIEEQMQTNEAEESLTRKEKLAERLMEVFGLEEREEVLEEMKCWMLRSIMLKGYMYLTKRHICFFANMPNENFWVVLKNDVLSWYENTSDPYFPKGNISLQYCHSCEAASGTRFKVRTSERNYTFTADTESSRDEWVKAIQKVMFRTQHEGESIKLIIPLEAVVDVDKSPTLEFTETIEIKCIDAEDQMSIDSYFFASFPNNDHAFSAIQKLVRERPSPPEVPRVSSATTIHVNQEPLDTSHATITRSGTDSSAEKLGMASHLPFRKFASVLKPLISKSSDGEPHEELSEDNHQDDHEASHLPHAEVTSNRQRSEEESDNDDFDGYPPRQVGPPPPSMNDDARNWRPSWIRKPASKLFGSSPSGSFVSSPGRSPMDSSTTVTETGPSLRTRAGRTKQSSVTEVLEPPIQHEEEVSEDEVPTKPSVVDSNSAEAARKRAASLSWTSETSSGSQMVKSKSDFSMLGSESGHSESAETLRKFRTFFALSDKEDLIDHFPGYLYRMIIPIRDLYGVKAQKAFRFGHSGLTVVVKGHEEIFIEFRSASRRKACITLLEERMEAVRLSGENNTIDSRKVEVRIMEDLDESTPIEPKSPWPVSSSPLFGSTTSTSFLEFKPEPMKITCLTIGSRGDVQPYIALCKGLQAEGHTTKIATHGEYKEWVEGHGIAFESVGGDPAKLMQMCVDNGMFTVSFLKEGLQKFRGWLDDLLNSSWEACQGSDLLIESPSAMSGIHIAEALRIPYYRAFTMPWTRTRAYPHAFAVPEHGRGGPYNYMTYTMFDQVFWRAISGQSGFMSLDTGSWIKRTRSRGRRVGHLQKASRTSFDNAHGEKKKVVYIGFGSIVVSDPEEMTRCVVEAVVNSGVYAILSKGWSDRGSKRGEPKGDSQGADGVKYPPKIFAIDSIDHGWLFPRIDAACHHGGAGTTGASLRAGIVSRNDCKNPTIIKPFFGDQAFWAERVETLNVGSAIRRLTSQQLAAALIKATTDEKQIFKARVVGEMIRKENGIARAIEAIYRDLEYAKSIIKTPSSTDEKTPEKISSLLHPLITADLGVRRVRSRSRSRSSHGRFSPRRHPVDDDGWSVVTGGSRSRSGSASAVASPERRSLNIGSALGSHVFKAPLLPNPFGKWGGSEGGDDR

SEQ ID NO: 7823 - protein, 625 aa, Gossypium hirsutum
MAASPEHRDDSSSSSPVEVPVKKELEICVDAKQIDSDGGSREAASGDNSRAEVDFALNNGAAEPYSIVHRSFSEVGTLRVGTSNIEKLDSSQPKLVKSKTEAPRHRSILAEDAAQIFDNKMSAQKKLQLLNRIATVKDDGTVEFEVPVDVEPHVLACGLRDEHIEVAEEESPEADIQCIPPLQVVILIVGTRGDVQPFIAIGKRLQEYGHRVRLATHSNFKEFVLTAGLEFYPLGGDPKVLTGYMVKNKGFLPSNPSEIPIQRNQMKEIIYSLLPACKEPDPDSGIPFKADAIIANPPAYGHTHVAEALKVPVHIFFTMPWTPTSEFPHPLSRVKQPAGYRLSYQIVDSMIWLGIRDMINDVRKKKLKLRPVTYLSGSQGSDSDVPHGYIWSPHLVPKPKDWGPKIDVVGFCFLDLATNYEPPESLVKWLEAGAEPIYIGFGSLPVQEPERMTQIIVNALEQTGQRGIINKGWGGLGNLAEPKDFVYILDNVPHDWLFLRCKAVVHHGGAGTTAAGLKAACPTTIVPFFGDQPFWGERVHARGVGPPPIPVDEFSLPKLVGAIKFMLDPKVKEKAKELAKAMENEDGVTGAVKAFLKHLNHKKPESEPSPVQSGLFSISRCFRCS

SEQ ID NO: 7824 - protein, 1491 aa, Rhizoctonia solani
MESSASPPNSIQNPVHGTTIDTSPGELGLSQPQSLSAMSESHDSSDDSDGGKGILKRTVEKIGRSTSLSRSKRHPDADSRTHRRLFSLSRHKGKDKAADEVTGILGGHAAGDGSSDADVSLQKSRTPTNSSTKSSPRVTRMAATTSDLRRNKNQASDSRPSLSIMGLGKQDEFGIGSMRMGTQALIQALQAMPWDDDRDDEATEAAARRDRGKARREAVSPDSSDEEEQAKADFVLASSIHTIHRPVAHSRLATPSFNQSIHYGTNPPFEIAEDYFSNPLSTDEDDGLRDFDEATPQESLPDPFKGPQMRLQLPADKLPKSEGKRRMPPTMRTASMATVRMKRRSKLAEKLKEVFGVPEIKEVVAEMPCWLLRSVLLQGYMYLTNTHLCFFAHMPTREDQVLKSGTMSKKAQRTKRWNKHWFVLKNDVLSWYQSSSDPYFPHGNIDLRYAISCDAHREKGIRLRTNQKTITLQADSVPSRDEWVKAIRKVIFKAQNMGESVKIAIPYSVIDGVEKSSAMDFSETIEVKVIDKEENYALDSYFFAYFRDLPAALAQIQQILLDYQATTPAADAHLTDTTQINRSPQQQHLDRTTSAPASSHQNDSSSGFRISSLLSLRPFSTTSGNDEAHKGSSMIASRSSEGVSAQRDPVSPENAAFGSTSILSEASAHTYPPSPSHQVPPSTHSNRTSISSNWSVPGYNWLRGKGVFSTPSSIDWGSRSTEGNVSEVISSPRLDQSELSVSSEGHNLGYSMLEAADESKIAHAALQEKFRSTFALDEKEELLECIPGSLFRVLPVYGRLYVSTNYFCFRSSQPLTRTRMMIPIRDILSTEKQKPFRFGQHGLVVVIKGHEELFFEFGSSERRDTCRSGLDRQKEALQKQALSPVSPTPTQGKRDALILEELEPSMLISDDDPRPAPEVLASDAPVMFASTSSTLLTFKPEKPMHFTCLTIGSRGDVQPYIALCKGLQADGHKVRIATHKEFQPWVEGHGIEFALVGGDPAELMRICVENGMFTVSFLREGVQKFRGWIDDLLETSWLACQGTDVLIESPSAMAGIHIAEALKIPYFRAFTMPWTRTRAYPHAFAVPERKMGGSYNYMSYVMFDQVFWRGISGQVNRWRRHTLRLPSTNLDKLEQHKVPFLYNFSPTVVPPPLDWYEWIRVTGYWFLDDPEDSSAKKWTPPPDLVTFMETARRGGKKVVYIGFGSIVVSDPDAMTECVVEAIKLSGVHAILSKGWSDRLSTKKSTSEPPPAYPPQIYPISSVPHDWLFERIDAACHHGGAGTTGASLRAGIPTIIKPFFGDQFFWSDRVEALGIGSSVRKLTVENLTAALRAATTDLKQIERAKLVGQSIRAENGVRTAIEAIYRDLGYATELFRKDTQVDLDADGSEDETIQESKTPAARRSSLDPVMIGSDSSCGSGRGNGEDSSWSVISDHPPPERVRVESTGSDKRAGGECGDDSMSEAQTSSAGQTKTSGSRAYSPSARGEPNGRQ

SEQ ID NO: 7825 - protein, 1466 aa, Endocarpon pusillum
MPTNEEPLKKRIGRKLSKKPKRLHRLPSSHVPERFKYGEDANEDVTAPARAGASAPQYMNQSIFSMIAAAGSRTDFNARFDDSSDSAEEDELGMEESAGGVSSQSSAARLSETSTTHPSNLDISPRKLSNEEKVHKRKPSEQRLLKSLPRLSLRPRKEKHSGTQQQANIGDEHSLDYSDKANYLTPRDAPMMSRMLEAQAELSASDLGTEATMRSDKVEKGRGQAGSSPATLLATRLMEIFGFEEPEDVISEYPCWLLQTVLLQGYLYITRKHICFYAYLPKKSASVAKTGYLAKRGRQNRAFTRYWFTLKGDVLSYYSNPADLFFPAGNIDLRYGISAFLCEDKDKQKTCKDFSLTTDHRTYQFRADSHTSAKEWVKNLQKVIFRSHNDGDSVKISLPIENVIDIEESPVIDFAETLKVRVVESGDTYAIDEYFFSFFSFGKDALDVLSSLVDHAATHNREASSPGSHGQHESRTASPEPRGSLDIRSSNTRFRSATPLRDSVKATFLPPPTPNSGRTSPRLSLDAGRSDKELKRPSIDLFRQEYGRASFDRGRRPGSQATTGRPSVESLTSQPPGGSDSFVQSMDRDTASTPIIHSPTTPTLESASQILNRSDVFLSPTISRLQDSHVRSSEDIRQTSESDERFASVAANIRQPSPSRTSHAKPAPHRALLQNDPLTSDTISRDGLQHKTSSPNLQDIMKAGSYPLQRAAGFAGYLKSSSTRMSKLLATESMGYLEKVSGMWAGGRRHYGEHEGIMPEDRLVDPEDEEAASGYGDRFRAHFALPASEKLRATYFAYLHRVLPLYGKVYISDRKFCFRSLLPGTKTKMILPLKDIENVEKEKGFRFGYHGLVLVIRGHEELFFEFNSSEHRDDCTVTLLQNLESIKYLVESGLLAQEDHDEAQVAKTEHQMLQEARQEGHAGHEMKLPGDDPKDAGTEEVPPILFDDPRASIINFTPTKSLSITCLTIGSRGDVQPYIALCKGLLAEGHKPRIATHAEFEPWVRKHGIDFSPVDGDPAELMRICIENGMFTYSFLREASLKFRSWIDDLLSSAWKACQGSDILIESPSAMAGIHIAEALRIPYFRAFTMPWTRTRAYPHAFAVPEHKIGGAYNYFSYVMFDNVFWKAIAGQVNRWRKKELGLRSTNLDKMQPNKVPFLYNFSPHVVVPPLDYSDWVRVTGYWFLDEASGWAPPLELVEFINKAHADGKKLVYIGFGSIVVSDPAALTKTVVDSVLKADVRCILSKGWSDRLGDPAAVKTEVPLPPELHQIRSAPHDWLFPQIDAAVHHGGAGTTGASLRAGVPTIIKPFFGDQFFFGSRVEDLGVGICLKKVNVSVFSRALWEAVHSERMIIKARVLGQQIRKENGVQNAIQAIYRDLEYAKTLINARTVGSKDARSGAVHNDDPAVDIEESWTFIGDESDPEIQKRIRDRDISTYKEPRASVDRSRPKAIEALKPSIAGKGSPE

SEQ ID NO: 7826 - protein, 561 aa, Genlisea aurea
QGLEYRTTTPPVQRNLFLTSQEFAISRSMTEKRFSSPMHSLNLDTLSENEKNNLIVNLVKIQNDGTVEVDLSKDSPVASELLELRSAEGIPPFDLLMVDNSDKPIPKLRIAMLVVGTRGDVQPFVAMAKRLQEYGHRVRLATHSNFGGFIKSAGVDFYSIGGDPRILAGLMARNKGLIPSSTGDLHAQRKQVQAIVESLLPACTEPDPVTGEPFKAQAIIANPPAYGHTHLAEALGIPLHIFFTMPWTPTYAFPHPLARVPQSAGYWLSYILVDLLIWWGIRGYINDFRKKRLKLSPIAYLTLYHAISQLPTGYMWSPHVVPKPDDWGPLVDITGYCFLNLGSKYQPSRQFDQWMQKGEKPIYIGFGSMPLEDSIKTTQIILEALEVTGQRGIIDRGWGDLGTDSDIPGNVFLIVDCPHDWLFPQCSAVVHHGGAGTTATGLKSGCPTTIVPFFGDQFFWGERVHQKGLGPAPIPISDLNVDSLAEAIAFMLKPEVKSRAMELAERIRNEDGVGAAVDAFHRHLPPEIPLPSPSPEEDDDSGPGPLQWLFGKIGRLCCLPC

SEQ ID NO: 7827 - protein, 1526 aa, Podospora anserina
QSSTMATPSQSTSSAVAVPIAPVEDTTAPSPAPTSSQSAALSKSQHLAHPPPSSAVRTPNAASHDERTVRRVSRKLQKKRHDDEHTPTMELPESLKQQGDHADSDEEVLRPQGYGGGMFMNMNQSIFGLIAAAGSQADFGDRFEGQSSDEDDNDVERENPMAMTIAGHKALHHKPSKSLSSHLAQSTVLRKHGATSNKVESKHRRKISESRLLRSVPGLSKLTSRAKSSLKPPKTQDAETEKPGEMDDKAEEASASQPASEVTPTIEITRTESRQTAPVMSRMLEARAQMAARPSFDLERPSGEQAHRPEAGETGPTELAKRLQEIFQFDTPEEVINGGNHAEFPCWLLQNVLLQGYMYITAGHVAFYAYLPKKANEVTKSGYLAKCGKHNPKYNRYFFRLKGDVLSYYRDTQNLYFPSGQVDLRYGISAEITDKDKEGVNFTIVTHKRTYYFRADSSSSAKEWVKSLRKVIFKSHNDGDSVKISLPIANILDIRVIDNDETYAIDEYFFSFFSFSEEAIDVLKTLVEGSSLQTPGQNELDEPASEAQSKRTSTSGSREQVLKSLNTRGGKITQSIKTTLSPISPGQRSPSPRPCLDGPRTSFDGFRPFSRRSVDVSRDDIRGKSPRRSFSERRTSFHRRHLSESGTDHDMERQEGSDSYVQSMEDPSQASMSGLIVSGSSEAPSASQILRGSEVFHNPAIHRSASAPRARNEPAVPEAPGTVKASRPPSISAQNGETEGNQAMPTLQNTATVGTFPFKGAGALMGYLDRQSRRMSNLLATESMGYVEKVSGMWKGGKKHYDEPAGLRTDEEDAEDNPDERATHEARFREHFALPKTEKLQAAYYAHMMRVLPLYGKIYIGNRHFCFRSLLPGTRTKLVLPLKDIENVDKEKGFRFGYAGLVVVIRGHEELFFEFNRAEIRDDCTITVLQNLEATRYVRDSGLLDSEDAEDAQAAVAERDALREARNEEFPHHEVKLPHDAHCVSEAPTILFDDPKASILNFKPSKSMKITCLTIGSRGDVQPYIALCKRLMKDGHRPRICTHAEFRDWIESHGIEFRPVGGDPSELMRLCIQNGTFTWAFLKEANSTMRGWLDDLLVTAWEACKGSDLLIESPSAMAGIHIAEALGIPYFRAFTMPWTRTRAYPHAFIMPGQKLGGAYNYVTYTLFDNVFWQTTASQINRWRNVWLGLPNTTLDKLQINKVPFLYNFSPFVVPPPIDFSDWIRVTGYWFLDEGDENKWQPSKELLDFIDKARADGKKLVYVGFGSIIVPDPAKMTQEVIDAVQKADVRCILSKGWSDRLPGSGDEKVPGPEEAKVEPQLPEEIFQIQSAPHDWLFKQIDAAAHHGGSGTTGASLRAGIPTIIRPFFGDQFFFGSRVEDLGVGICLKKWGANSFARALWEATHSERMIVKARENGVDTAVQCIYRDMEYATNLIRSKMGKNHARTGENVSMTEANLNNEDEEESWTFVGDSDTVEDLSSEALMKTVADLRDLQAYHGDNADKTQGNTVVGGAVGAGVETVKGKGVS

SEQ ID NO: 7828 - protein, 1233 aa, Rhizoctonia solani
  MOD_RES (1207)..(1215): Any amino acid
MGRNTSISRSKRQGDADSRTHRRLFSLNRHKGKDKAAEEVTGILGGHAAGGISNDADVSLQKSRTPTNSSPRSSPRVSRMSATTSDLRRNKNQASDSRPSLSVMGLGKQDEFGIGSMRMGTQALIQALQAMPWGEDRDEDLPESAAKRERGKARRERVSTDSSDEEEQAKADFVLASSIHTIHRPVAHSRLTTPSFNQSIHYGLNPPLEPAEDYFSNPLSADEDDGLHDFDDTAAPEGLPVPNPFKDPARMRLQLPADKQSKLEGKKRMPPPMRTASMATVRMKRRVKLADKLKEVFGIPEIKEVVAEMPCWLLRSVLLQGYMYLTNTHLCFFAHMPVREDQVLKSGTMSKKAQRTKRWNKHWFVLKNDVLSWYQSSADPYFPHGNIDLRYAISCDAHREKGIRLRTNQKTVTLQADSVPSRDEWVKAIRKVIFKAQNMGESVKIAIPYSVIDGVEKSSSMDFSETIEVKVIDKEDNYALDSYFFAYFRDLPAALAQIQQVLSDYQTTSPPGEAHLTDTTQAHRSEEPHKASSTITSHTSEGVSIQHDPASPESAPGASSILSDASAHTYPPSPSNQAPPSTHSNRTSISSNWSVPGYNWLRGKRLFSTPSSVDWGSRSTEGNVSEVISSPRLDQSELSVTSEGHNLGFSILEAAEDGKAADAGLEEKFRSTFALDEKEALLGCIPGSLFRVLPVYGRLYVSTNYFCFRSSQPLMRTRMMIPIRDILSTEKQKPFRFGQHGLVVVIKGHEELFFEFGSVERRDACCNLIEMQKDVLQKQALSPFSATPTQGKRDALILEELEPSMLISDDDPRPAPEVLASDAPVMFASTSSTLLTFKPDRPMHFTCLTIGSRGDVQPYIALCKGLQADGHSHRRIATHKEFQPWIEGHGIEFALVGGDPAELMRICVENGMFTVSFLREGVQKFRGWIEDLLETSWLACQGTEVLIESPSAMAGIHIAEALKIPYFRAFTMPWTRTRAYPHCFAVPERKMGGSYNYMSYVMFDQVFWRGISGQVNRWRRHTLRLPSTVDAACHHGGAGTTGASLRAGIPTIIKPFFGDQFFWSDRVEALGIGSSVRKLTVENMTAALRAATTDVKQIERAKLVGQSIRAENGVRTAIEAIYRDLGYATELFRKDTHVDLDGDESEDETIQESKTPAARRSSLDPVMVGSDSSCGSGRGNGEDSSWSVISDHPPPERVRVESIGSDXXXXXXXXXWRVANAECGPGIGIAWAF

SEQ ID NO: 7829 - protein, 409 aa, Streptomyces cellostaticus
MTAGSRGDVAPYTGLGHRLGRAGHEVTLVTHGCFEPLVAGSGVRFHALPVDPRTELESPRGRGLHRSTSGAGKLVRVVELARRLVGRMTDDLVAAARESDVLLLSASLAPLGHAVAEGLRLPSMGVYLQPLAPTREFAPPVLGGGSFGAPGNRLTGHGVNLAVERVFAATVPAVRARLGLPPIRTGTARRTRERRLWPVHHGFSPLVVPRPRDWRPGLGVCGYWWPYDAETRLPQELRDFIEAGPPPVFVGLGSATVPDAGRLSAQIVAALRRAGLRGVIQRGWGGLTAQGDDMLSIGEVPHSALFPRMAAVVHHAGAGTTAAGLRAGVPAVPVPIQFDEGFWSARLVSLGVAPAAVPLRRLTVEALSTALLRATHEASYSERARTLGARIRAEDGATPVLDAVTALGG

SEQ ID NO: 7830 - protein, 413 aa, Unknown
  Description of Unknown: Symbiobacterium thermophilum IAM 14863 sequence
MKFVILATGTRGDVQPFVALAQGLRAAGHEAVLAAPGSFESFVRSHGVGFFPMGGDYAALLESPEAQAALRGNPVKMMQVVRQTVFPMMGRMLEDAWAAAQGADALVYHPKALAGAHLVERLQVPCFIGAPVPVVVPTAAFPAPAFVSRDLGGFLNRLTYAAVRSGSRPFRGMINEWRRQVLGLGPRREGEYVQGGRLIPVLHAFSPHVVPRPADWPPEAIVMGYWFPRRDEPWEPPAALAAFLEEGPPPVYIGFGSVSGIDGDGSTRMAAEALARAGVRGVIATETGDAPVRLSDTVLAIPGAPHDWLFPRMAAVVHHGGAGTVAAGLAAGKPTLVCPATTDQPFWGRVVHRLGVGPAPIPRRRLTAERLAAAIGTLTTDEDIQRRAAALGEAIRAEDGVGRAVAEILRCSG

SEQ ID NO: 7831 - protein, 1358 aa, Hortaea thailandica
MQVPDRFKPDEEDEEEDVTGVAEPNAGSVQQSFYGMLGAAGQKQMGRTGFLPDSGSESEGDTETEDSNRRSRQHSASASRVSSARPSVDEQCQSPQPESSRHRKNKPSETTLMRQAFKPIREKGDVSDLDLMSQSQFLPSRENQVAAPERPRSATGVMNDAPILDRRLKAKARAEQESSAASSSRRSSESTRSASSSQKKQSVNLPMALAEIFQFDEPEEIIAEYPCWYLQSVLLQGYMYVTKKHVCFYAYMPKKGSASVRSGHLGKQGKRNPRYRRYWCQLKGDVLQYFNDAANPYFPRGTIDLRYGISAELVPEKGQEKGKESGTFTVTTETRTHYFRADSIASAKEWIKQLQKIIFRSNNDGDSVKISLPLANVVDVEANPVIDFAETIKLRVVDNGETYAVDDYFFTFFNHGRDALRMLNLLTEGNEARKLVFGVNNALASDERPTHDEIDRPSLGRARASFDTARQGKGRTTSASFQQPHKISQPPISPSAGDSRESLYSTAEQEAPSPTSPDVTGEVDMSASQILTDDGAFRAPTLRMPQPRQMVSGKTAEGLPGESKDTSRAHDPAQERMSTQPQRRTSDEVPINTEMQSIAVRPPNTSRPSMRVLAAPWQHAASLYGHVRSQSKRGVSYLSSSPKDFYSRISGAVAGGKRYYSEADRPPPDDSIPDPENEMDVAEHEKRFQQHFALPESEKLVAVFYCSLHRVLPLYGKIYISTRNFCFRSLLYGTRTRIVIPLKNIDNLEKEKGFRWGYPGMVVVIRGHEELFFDFASNGLRDDCVVTVFRAVEKAHAVAESVILTEDERQDAEAAAAEHEMLHVARGGGQAAPDLKSPSELDVAGLGGAPILFDDPNASLLDFKPKQPLRITCLTIGSRGDVQPYIALCKGLKAEGHHPRIATHHEFGGWVRKHGIDFVPVEGDPAELMRICVEYGMFTPSFLLEVNSKFRGWLDTLLFSAWQACKGSDLLIESPSAMAGIHIAEALGIPYFRAFTMPWTRTRAYPHAFSVPAKKMGGHYNYYTYTIFDNLFWQITAGQINRWRRKALSLQPTSLEKLQQNKVPFLYNFSPNVVVPPLDFSDWVRVTGYWFLDEGDDWTPPEDLMRFIQKAREDKQKLVYIGFGSVTVGDSKQLTQQVVDAVLKADVRCILSKGWSDRLEVKDPTAIEVPLPTSVFQIRSAPHDWLFRQIDAAVHHGGAGTTGASLRAGVPTIIKPFFGDQYFFATRLEDLGVGIHLKKVTVNTLGRALWIATHDERIRTKARVLGERIRSEDGVGTAIKAIYRDLDYAKTLIKRRPKQIGSGAEIDEPEEESWTFIENDGDNELVTARLGEVVTAETLSQGNWARSGRQSDMGSKAL

SEQ ID NO: 7832 - protein, 1453 aa, Moniliophthora roreri
MANKLPSLQPLTHDPAVAPTIDTSPESLGYLETGVSNSADSSPTASRVKRFSSAVEKLGRSLSGKASPTSPPSGAGHRRLFSINRKGKGKAEDGLSASAPSISRPLSPMGSQPRKSQDDSPFITPPSPTLPASRPSLSAFRGGGSMRAGTQTLIQALQALPWTADPDNDDEVLDHGLPHISDEDGSEDEGQTKKPLASSIHTIHRPVARSMRMSASGRSRVRLNLPNLSPSSDDESPPDIPQSDEDVEDIPDFEERTPRPPDADRVPGLPQKSPQIPGTMPDRIYMSRSGSMATVRLQRRTKLAEKLREVFELEGIDEVRAEMPCWLLRSVLLQGYMYLTNSYLCFFAHMPTKEDQILKSGSLNKKAQRTKRWIKHWFVLKNDALSWYQSSSDPYFPHGIVDLRYAISCEPVGERGFRLRTNQRSVYLSADSVPSREEWVKAIRKVIFKAQNMGDSVKIAIPYSAILDVDKSDAMDFSETIEVKVYDKEASDHFSVDSYFFAYFHDISGALEQIRDAVRAQRTFPGGERAHTVLDTTASRPQAAASEKPSMPSSSSSLFRITSLLRPFSEPRSSNTVTTSSSAAGGAEDFTHISRRPDSSSFVPVTTSGAHTPPKGDPQKHTQQSSSDLLTPTPSNVGVDHTTTSAYTLSSLPSSSSSWTVGVPAWLKASKPRVLSFGSNTSEAVQVAPPGGKVREMYSSTSGSTGTSSRWSGVGDLAYSVLENPGNPVDDDAVERFRAAFAYDEKETLLGYFPGYIFRLLPVYGRLYISTNYFCFKSTGPLAARTRMTLPIRDILSVELSKATRFGHHGLIIIVKGHEELFFEFGAEDKRDAFVALLERQMEDVRRRIASGEAPLPTQGQRDALILEEFEPKPASQSEITEPPMPESMSDSLPAVMFTSASSTFLTFKPQKSLHFTFLTIGSRGDVQPYIALAKGLMADGHRVRIATHGEFKEWIESYGIEFGYVGGDPAELMRICVENGTFTVAFLKEGLLKFRGWLDDLLKTSWEACQGTDVLVESPSAMGGYHIAEALAIPYFRAFTMTWTRTRAYPHAFAVPERKMGGSYNYMSYVMFDQVFWRAISGQINRWRRNVLHISSTSLDRMEPHKIPFLYNFSPHVVPPPLDWPEWIRVTGYWFLDSADVSAKKWTPPEDLVKFLDTARSENKKVVYIGFGSIVVSDPKTMTRCVIDAIVQSGVYAILSKGWSDRLHVKASEASEPEEPLPKQIYSISSIPHDWLFQRIDAACHHGGAGTTGASLRAGIPTIIKPFFGDQFFWADRVEALGVGSGVRKLSVESLAEALITATTDVKQIDRARLLGEQIRAENGVATAIESIYRDLEYARSLIKHNVSESEDDDSIDNEHGTVRDHDFSNSELRSGDSSSGSARGAPSEDWSVISDQDERRSSVSSRHSEGRRPSADRGKRTSLAAAMLSVLPDSLNPGSPRRRTVSTGSKA

SEQ ID NO: 7833 - protein, 1242 aa, Zygosaccharomyces mellis
MDIKGKVPFLRKIEGSFKKNDSSKTKGKSSQGDRGSPSASLDQTPSNKTAMFSTKDEPKSELSVMESNRQMGEDQDDSEDSEGPDTAEGQYASKNIVGLLTTASVMAGMGDQQQANDVADDLDGGEIGSEEFVDAKSEVSTELERVDVSKIDDANEPARSEGSATLRSPGFDLSVEPVGKNRDYLSSLDDDTKRTMVEKLVDHFKLHEDEKFVGDFPGFLLKDILIQGQIYLTSMHVLFFAYLPSNSDEVQLSGNLNVHSRIRGSTRYWAVLRNQSLSLYSSPTEIYFPELEIDLKNTASIAVIQNRGTGKSTNSFKIETKKRSFTFSADSEFAARSWTNSLKKQHFAALNAEHNSVSLKIPLVNATEVIDERVAEYASTVRVKALESSASGINVEFVFVFLDNSSTFFKRRVDAQLELLQQRDVPSLAHVPSKEDSAVSDSTTSLRPVVNHNDLDASAAEKSPKRSLRHHHLLPHLARHQEPSSSSEKLGALSSLRPKFVSKHQSAGDPDASDSYIHSLSPVRGAKDTLGTFVQELNTKAHIMTDGSLWSSSADNETSSGTEFKKGHQRKYFRHGLWNNKPIHYRNNVISFGEEDSYLASPDENREANERFREHFHLNSDDNLIGAYFSHLNRSIPVYGKVYLSEEIMGFRSLLPGTHTKMNLPLVDVEACYKEQGFNFGYEGLILVVRGNAELCFEFSSTEARDDAQRIILEMVKVLKSKRREIMNPTTNILELDPHFAKMKLVEDKINARGIDAPLLVDKNPYYETTIKPHGKRLKIGLLTIGSRGDVQPYIAFGKGLQREGHDVVIITHGEFREFVETHGIAFDEIAGNPAALMSLMVEHESLNVGLLKAAAANFKSWISELLKTAWEACVRLKIDVLVESPSAMAGIHIAEALQIPYMRAFTMPWTRTRAYPHAFIVPDQPMGGNYNYMTHVLWENVFWKGISGQVNKWRIETLKLPKTNLELMQQNKVPFLYNVSPTIFPPAIDFCEWVKVTGYWFLDEKQSYTPPPELKAFIDQARRLNKKLVYIGFGSIVVSDAKEMTKAITDAVLEADVYCILNKGWSNRLGSRSDEKETEVALPESIYNAGSVPHDWLFPQVDAAVHHGGSGTTGASLKAGCPTIVKPFFGDQYFYATRVKDIGAGIALKKLTSKSLARALVDATHNDKMKMKAQDIKEKIGMENGVKTAINCLYTELEYARSLVVTKAEQRNNSKSRHLEIPSFSAPKLPELNLEKTFAFL

SEQ ID NO: 7834 - protein, 1505 aa, Phytophthora nicotianae
MEAAQEEDKTVAMETPPQTAELEMPQASAEQEHKPKRWKEAFARAVQSIADERRRQSIDVGKFTSFADVVHAAAAFDRDGHIHMDFDEDDDKYDISELQEQDKCREDKSLRTTRQSSRTDYNAPIMTICIMIVGTHGDVQPFVAIAKRLIQDGHRVRLATHAVYRDLVMSHGVEFYPLAGDPKELSAYMVKTGGHLIPLNLEAIQKDVPRNMQMIEEILYSTWPAVSEADPDGDGPGIPGKPFQAQAIISNPVTYGHIHVAERLGVPLHIMFPQPWVPTTAFPHPLANMPYTGKPKKVNYMSYKMVDLLMWQGTEGMVNAFRRDKLQLRRIRKGDGGRDILLDLSIPHAFMWSPHLVPKPHDWGKIYDVIGTVTLGGPSSSYTPSPELEAFLGDDAGPVFVGFGSMVIEDPKGVTKMIIEAAEQAGVRVLIQSSWSDMAGDLTIPDNIFFLGNCPHDWLMPRVSAVVHHGGAGTTAAGLLAGKPTFIVPFFGDQPFWGRAVFDAGVGVEPCPISQLTTQKLRVAFEALESPELRIRAAELRDLMRHEDGAGEAVRSFYRNLPLHHMRCDLDCGQAATMWSQKDKIRLCDECAFVVASRPENSAKDIVEYTFVDYSARGPENVLEGAASGVGAFAHVFGSGFKDVVVKPAQGYREEGAKGAVIGLVKGLGGLMISPLVGTVVFADHLATGAYNNVRGGEDKKKGSLIGDNKKLLNAMGFKTRNVHTGSMSADEVIDGDNLLSSQVAVQLTPEEKSTLEDRFNALIKERKLHGQRALKLANSSLSTSASVDSADEGATVVVNVDGATFNGSDSFDIVFGDGGKVGEALHENEVQELEAEARKEEEAHKKRLESLNSTPLPKMNICMMTTGSWEESVQQYVAIGLRLKADGHCIRIATNSGHRDRIVSAGLDFYPLGGSAITTGNFLKYLHQRSQDQPRHKSRLLNLAHSKLNHRRESFPEVDDLRELVFSLWPACVEVDPLVPGKAFRADAIIAHPYLFGQTIVAERLGVPLHCMSYNPQSRTQAFPHLVSSNMKLHRPYRYAPTNAASYDVIDNVLWNGMRDVLDDFRHSLGLTGRSIANNLLAEWRIPHTYLWNPAILPKPHDWGSEITIAGYVELKESDDDNTDLAAIEQELQSFTSSSAGTPLIYFGFQCSDWDPRRVQDLLGSLEKAARKANVRVVFQGYENSNDDAALFVGGTDVVFEIDQHFPVQRVLPHVDAAIHWGDLSITSTCLAAAKPACVVPRNITQRMWGQALVLSGAGIEPLELDALTPSNLIHVFHMLLDPKLTHCAKRLAPKFSSSTAIETAVSAFYSNLPLAGMRCDLDPARIARVYDSLHEMKLSYEARLVVHQITKDAGSAGDLKYKPLKYSQHHPPRFSLRELELLHPASSNNLKKQPRTKILYTYDPASEELAARVDHERASVTSPSSSKEAKKYGGAPRKKLLQFSRAQSMALNVVELPKFWNSPEEQAERTLEINDKYEKLLVTRKFANGTSSSSASSASSVAI

SEQ ID NO: 7835 - protein, 1161 aa, Aspergillus tanneri
MVEAQALLVPEAAAERSQSSIERSDKDPQQPGSSALSLRLMEMFGYECPEKVIVEYACSLLQSMLLQGYMYVTEGHICFYAYLPRKSTVAIKSGWLHKRGRKNPKYGRYWFSLKGDVLSYYADPSNFYFPSGHVDLRYGISASLAEQKDKSKETKDFQVTTDQRTYYFRADSHASAKEWVKALQKVIFRTHNDGESVKVSFPIGNIIDIEESPMVDFAETFKLRVVDRDTYAIDEYYFSVFNTGQDAYNFLKGLINETTTKNSQTLSSKQDHTANHGRSRGYQNRWSLSNVLSQPRGIGNVGSQQRSVSTSHISFGHDVVGTSPPTKNPEPSDSFVNSFEQATESSAVLQSMTDTTESASQILNRSDVFQSPTIHTLRHRPSDTDRTGRRHSDETARSISNAVADSSTFPRRHGHGIQYAISESDQETQGASKVHTSAPSLNELVRAGVYPLQRAAGLAEYLKNRSKQMSTLLASESMGYLEKVSGMWAGGRKHYGEGEGVQPDDQDVDPEDREDGCGHGDRFRAHFTLPSTERLQATYFAYLHRVLPLYGKIYISQKKLCFRSLIPGTRTKMILPLKDIENVEKEKGFRFGYHGLVVVIRGHEELFFEFNTSDARDDCAVTLHQGLESVRFLAESGMLAEQEKDESEAAKAEHLMLQEARKDATGQYDTRTILDESSELHPIFDDTRASIINFKPSEPLRITCLTIGSRGDVQPYIALCKGLLAEGHKPKIATHAEFEPWIRKHGIDFAPVDGDPAELMRICVENESPSAMAGIHIAEALRIPYFRAFTMPWSRTRAYPHAFAVPEHKLGGSYNHITYIMFDTVFWKAIAGQVNRWRKNELGLKATNLDKMQPNKVPFLYNYSPSVVAPPLDYPDWIRVTGYWFLSEGTDWSPPAELTDFIQRARKDGKKIVYIGFGSIVVSDPSALTRTVIESVQKADVRCILSKGWSDRLGDPASAKPEIPLPPEIMQIQAAPHDWLFAQIDAAAHHGGAGTTGASLRAGVPTIVKPFFGDQFFFGNRVQDLGVGICMKKLNVSVFSRALWEATHSERMIMRARELGVKIRSENGVETAIQAVYRDLEYAKTLARQRSIVSSTPFSPTPSAKTIAEQEEDDGMTDSEEWTFVGDDTDIDISRRVRDRAISDADMLPEPVSGYASTKIA

SEQ ID NO: 7836 - protein, 417 aa, Alteromonas mediterranea
MNILILTYGTRGDVQPYIALGQGLKRAGHCITLATSSRFRKIIEHAGLHYAFMNDGMLTLLDAPEDQGALEDTNNIFQVVKRTLGLLKKIGPIQRALVDESWVAAQQSKPDIIVFHPKAFTAPDISEKLGVPVLMALVVPGLVPTAEYPNMMLPRLRLGGWYNKFSYSFVNRLIGLSVAKYARAWRKAHHLPKAKRFSLLHTADGTPIPVIHGFSSLVVPRPDDWPQTASICGYWHTEDDDHYEPSPELSAFLNTGPPPVYVGFGSMTGRDPERLTDIVIEALQRAGVRGILATGWGGMEIKALPESIIAVDQVPHSWLFPRVCGLVHHGGAGTTAAALQAGKASIVIPFFGDQPFWGNRLHSLNAGAAPIPLKKLTVERLAAGIKEITTNQTIIEHAAALGASLREKHGVEKAVAM

SEQ ID NO: 7837 - protein, 1143 aa, Dacryopinax primogenitus
MEETEDFDPVPAPAPSTATRPLNIRTQSLATVKLQRRGKLAAKLRDVFGLSDIEEVLAEMPCWLLRSILLQGYMYLTNAHLCFFAHLPTDEDQVLKSGTLSKRGGRTKRWNKYWFILKNDVLSWYQSSADPYFPHGNLDLKYAISCEPIGERGLRMRTNQRSVNLMADSIPSRDEWVKAVRKVMFRAQNTGESVKIAIPFNLIVDADKNSSMDFTETVEVKVYDRDEKDENYSLDSYFFAYFHDLDRALEQIQTIIQQHRRAVTDPAAKLGMLHDTTSAGVVSSIGAPDRPIQSDPRSTTFRLTSLLRPFTSYSQVLGLPARTESAPDHINDFGVSRISSQELVASPAPLQDDSRTLKPGLFRPLTTSSEAGPHTSSFPEVGLPHIYPPSWNSSPGQHYQTLQAQQDPSSTGWSVPQWLRGSSRLFSATQSGGDSSSLPHSVILSDHASDDEDREGSNNMGFSLLDGTDVPYVFDPVVAEKFRTTFALDEKEGLIGYIPGSLLRVLPIFGRVYISTNHFCFRSTQPLTKTRMIIPIRDIISAEKQRAFTLTYHGLAVIIKGHEELFLEFSSADRRDACIRLLESQMDVVRQKELIGPSAPTQSQKESDILEDLEPSTPALESEIPRLDAGQEVAPAVMFTSTSSTFLTFKPQEPLRFTFLTIGSRGDVQPYIALAKGLQADGHHVRIATHGEFKAWVEGHGIEHAYVGGDPAELMRICVENGMFTFSFMKEGLQKFRGWIDDLLKTSWEACQGSDVLVESPSAMAGIHIAEALGIPYFRAFTMPWSRTRAYPHAFAVPERKMGGSYNYMTYVMFDQVFWRAIAGQVNRWRRNTLNIDSTNIDKLEQHKVPFLYNFSPSIVPPPLDWYEWIRVTGYWFLDDPDNSQAKKWTPPDDLVQFINSARAEGRKLVYIGFGSIVVSDPDAMTQCVIQAIEQSGVRAILSKGWSDRLSSKKDPKALEKEHAKLPSTIYPIASIPHDWLFARIDAACHHGGAGTTGASLRAGIPTIIKPFFGDQFFWADRVEALGIGSSVRKLTVDSLTDALRNATTDEKQIARAKLVGQKICAEHGVANAIEALYRDMEYARSLVKRHRAEGEEHLRTSGIREGVSSADMRESSLDSSSGSAMGTSEDWEAVSCSSAQGH

SEQ ID NO: 7838 - protein, 1041 aa, Penicillium oxalicum
MPSVVPTTEGATAARHNQIESEDWPTQLSDASSPRSSGERMQFNGDGLNTGVRILGDGRLKIRINQYRPNIAGLLNLARSSKSHKTAENQAETPAGDQASKVDESIRRAEKEADNFPLHLNVVIQVIGSRGDIQPFIALGKELKKHGHRVRLATHLAFREFVLDADLEFFNIGGDPAELMAFMVKNSGLLPNMDTIRSGAILKRRREMKDIVDGCWRSCFEMGDGTHLHQIKDDLWSEEQDYRRRPFVADVIIANPPSLAHIHCAQKLGIPLHIIFTMPWSPTQAFPHPLAVIQQQDCKPSVANFVSYAIVDMMIWEGLGDIVNKYRRTVLSLSSLDAITAPSILHKLQVPCSYLWSPAILPKPEDWGDHIDVCGFSFLPAKPDYDPPKEITKFLESGPTPIYVGFGSIVVDNQKRLTETVYEAVKKSGQRAIISKGWGNVGVDDVEVPDNILVIGSCPHDWLFRQVSCVVHHGGAGTTAAGLALGRPTIIVPFFGDQQFWGDIVARNGAGPLPIPHKELTVDGLSNAIEFALKDSTREKAQEIAKKMEGESGVRDGVRSFHRQLDLRSLRCAVCPTRPAVWHLKHTEVGLSALAAAILVETGKVDPQDLVLNRPKEYDTYRDPVGPISASAQVLFGAIAHFVGGIADAPAYVVSDLAVARHALESSHGRTDLNREWRRHRSRSRARSARIDNKARMSNETRSSEETRASGETDPSKGSHPSNETRTSDRTWEDDQVQANDGVQSNVDTQTGGERARSGEENHPSHTVGDTAQQRSPKRNEDAHNSDGVESLSDESGSCDATRAEPNLELERECSIKLQRTATMASVNTTSKSHNILYEIASLGGKMSLKFVNLLIWLPTDLTLSLSKGFHNAPKLWHDPMVRSTPKVHDIQSGFKAAGKELFHGFYDGVTGLVVQPQHGYKENGAKGMMKGVGKGIGGVFCKPPAGLWGLAGYPLMGIRRKLLDSLGRSSEGQIVLSRIAQGHEEMYASTPAERAEVIKKWSVIEKSLTPGLSSYLLKTKRWFITSSRDAHRIADTAIQA

SEQ ID NO: 7839 - protein, 1393 aa, Aspergillus calidoustus
MRPFLDDAKRRVDQRLSASRQSLSTSRMFSSAFPERLKDDQDDAQIDYTAPPGGNRSRDGLQYMGQSMLSLIAAVGTRSDFRARFDDSSDSEGEGETDTRQVAHSQEADSPRLDGTLQVPPSPGDRSSSQDRGRRHRRSISDHKLFQPLKTGLKRDKGRETTAPPPQPSTNERLSPFPALPSLPRPRSATPRAAPVLSRMLEARARLESEEMESSETLETSQEGKNDSIAPQSKASPLSLRLMEMFGFSTPEKIIVEYACSLLQCMLLQGYMYVTEKHICFYAYLPRKSTVVSKTGWIHKRGKKNPKYNRYWFELKGDVLSYFAEPHNRYFPTGRIDLRYGISASLTESKEKGRESRDFQITTDYRTYYFKADSSRSAKEWVKALQKVIFRTHNEHDSVKVSFPVENIIDIEESPMVDFAETFKIRAVDAEDGVAIDEYYFTFFKSGRDAFDILKGLIGETPTRGSPSGLSPQPNCATDSRRARGSQSRWSITSANKLQEPLSTSSRRRRSASASLLGSEPHGAATSPRIRQQDSAGSFIQSIDQTTESSAVLQSVTDTTESASDILNRSDVFQSPTIHNLQKQSAGPIRSRRRNTDETARSIAEHGLDGLVRGGPETQDAISDSGQESKDVSRLTSALALNDLVRAGSFPLRGAVNIAEYVKSRSKEMSTLLATESMGYIEKVSGMWAGGGKHYDEVDGRPNERGLDLQTKEKDAERFRAHFALPPTEKLQAAYYVHLHRMFPLFGKIYLSQNRLCFRTLLPGTRTKMILPLKDLENVEKEKGFRFGYHGLVLIIRGHEELFFEFSDPGSRDDCAVTIHQRLETVKFLAESALLTQQENDDSEAAKQEHRMLQEARLDASSEQELRSALDESSEIQTIFDDPRASIVNFKPTESLRITCLTIGSRGDVQPYIALCKGFLAEGHKPKIATHAEFEPWIRKHGIDFAPVDGDPAELMRLCVENGMFTYSFLKEATAKFRGWIDDLLSSAWKACQGSDILIESPSAMAGIHVAEALRIPYFRGFTMPWSRTRAYPHAFAVPEHRMGGAYNYISYMMFDTVFWQAISKQVNRWRAKDLGLKSTNMDKMAPNKVPFLYNYSPSVVPPPLDYPDWIDITGYWFLNEGSNWTPPKELADFMKRAREDGKKIVYIGFGSIVVSDPAALTRTVIESVLKADVRCILSKGWSARLGDPSSAKAEIPLPPEIHQIQSAPHDWLFSHIDAAAHHGGAGTTGASLRAGVPTIVKPFFGDQFFFGNRVEDLGVGICMRKLNVSVFSRALWEVTHSERMIVKARNLGERIRNEDGVGVAIQTIYRNLEYARTLTQQRLIASSTPLSPTQAAKPDTEDDFADIEDWTLVDDEAEFDAAKRARDRTVSDANNSPEPFFLGSTHFVDSPK

SEQ ID NO: 7840 - protein, 1491 aa, Monosporascus sp.
MELPERLKDHGEDAEEDAIAPSQGPQMFMNMNQSIFGLIAAASSTVDFNDRFEGQSSDEEDDAGDDDAIQRQTKGKGREDVAQTTVLGKAASGKEQTGRHRRRISGQLLRSLPQLPRLATRSLSKRSSKLKASRGSDESIGHEGDAEAPESPQMTEPRFPKIEVTKADREGRRAPVMSRILEARAEMSSRPSFDLERLSGDRRREGGDVDEAGPSALSRKLKEIFEFEESEDVVEEYPCWLLQSVLLQGYMYITSKHICFYAYLPKKAHEVAKSGYLSKSGKRNPKYNRYWFRLKGDVLAYYRDASNLYFPNGQIDLRYAISANITDKDKDGLHFTVVTHHRTYYFRADSAPSANEWVKSLQRVIFRSHNDGDSVKISLPIENVLDVEDSQMVEFADTCKIRVIDNDETYAIDEYFFSFFSFGKEAINVLKILTDDASKQQTREAIAVFATPGDGQPASPRQGSTSMGREGSPSPGSGARSPRLRENVRATLSPKLPESRSPRASADLSRSGFDPLGIFARKSMDRETVSPNTHHRRSFSAGRSLSGHGRPSEQRTASEKHESSESFVQSSEDPSGMSALMESSNEDPSGSQILRGSEVFHNPTIRRTISDASATQKKRSSSRHRLSHKPDDVFLTSHVKHAAGEGQLGTGVTGGGHGQVPPDTPTLQNLVKMGAYPLQRAGLFANYLNQTSRRMSNLLATESMGYVEKVSGMWKGGRKHYHEQPGLKTDDELDDGDEDTQVATATDRFRAHFALPETEKLRATYFGFLSRVLPLYGKIYISDRHFCFRSLLPGTRTKLILPLKDIENVDKEKGFRFGYSGLVLVIRGHEELFFEFSQADVRDDCAVTLLQGIEAARYLRESMILGKGEQELADEAMAERDALQEARLQLNPEHDLKLPQTASTLSDSSPTILFDDPKASFLNFKPAQPMKVTCLTIGSRGDVQPYIALCKGLMAEGHKPRIATHLEFKSWIEGHGIEFAPVEGDPAELMRICIQNGTFTWAFLREANSKFRGWLDELLVSAWTACQGSDLLIESPSAMAGIHIAEALGIPYFRAFTMPWTRTRAYPHAFVMPEHKMGGAYNYFTYLMFDNLFWKATAGQVNRWRATSLGLPPTSLEKLQPNKVPFLYNFSPSVVAPPLDYSDWIRVTGYWFLDEGNASGWAPPDDLQRFIEQARADGKKLVYVGFGSIIVPDPAKLTQEVVDAVLRADVRCVLSKGWSDRLDKGDGSGAAAAVPEVPLPPAIFQIKSAPHDWLFGQVDAAAHHGGSGTTGASLRAGIPTIVRPFFGDQFFFGARLEDLGVGICLRKWGTGAFARALWEATNSERMIVRARVLGESIRKENGVDTAIQSIYRDLEYAKSLIKSKTGKNAAAAQANANAAGASGQGSTDGVASGNTDDDDEEESWTFVGGGSGDDALEQELAAKKGGVLSGSEADSIGSFPGGGASTTPTAGNGNAGATSGRMALGSKLLGGGRGSSISSNNSNKPTVAASS

SEQ ID NO: 7841 - protein, 740 aa, Aspergillus niger
MANGAAASIPLALLSAPADRRRHGHPTDGRDSEAHVTDDGRVGIAVDEDDPQVASLLQALQRRPIPHPSEIEKEAYFPLRLNVVIHVVGSRGDVQPFVALGRALQKQGHRVRLATHFVFRDFVKDNGLEFFNIGGDPAELMSYMVKNPKLIPKMETLVKGTVGRRRGEIRKMIGGCWRFLSMKSRQTVIDVPRMPWSPTQAFPHPLANILTHDTRPSVANFVSYILTEMLIWQGVGDLINEFRRFELGLDQLEGTGAPSLLHRLRVPFTYLWSPSLLPKPDDWPDHINVTGFQFLPSNRDYTPPQDLADFLETGAPRHYALTQTILEAVEITGQRAIISKGWGGLGADEINQRDVFFLGNCPHDWLFQRVSCVVHHGGAGTTATGVALGRPTIIVPFFGDQPFWGSLVAQNGAGPPPIPIRNLTADRLASAIHSCLKPDTAEKAQKLGENIRAEDGARSAVDNFHQQLDTQRLQCALCPDRPAVWRIKSTRILLSAFAATVLVVDKKLNPKDVKLYYSKRYNTNYGCLGTEAFAGAMSNFLTGIVEMPLNAVQNIRQPPSDRFAAHYNLPSHEAYQTMQSPGSPRVFGQGEGTLNNDTRVTPGLTAATTIKSQADAPSMATKRGPLQKLAASASYMGRRTLNWMVEVPMGLTVMLSQGFHNLPLMYHDRAVRDTPEVTGVKSGFVAAGKEFAYGIYDGVTGLVTQPSQGWNDGGFGGMTKGIGKGVGGVLLKPQAGEWSR

SEQ ID NO: 7842 - protein, 891 aa, Trichoderma atroviride
MLLSRTRSATAPHVGADQGLKKDVAPVAPEEKGCYGCDGRFKVCFETDTGGLVSWCKDLQKASQRVKNDVCSDPVCERRKSTGGLRPPLNIAILIVGSRGDVQPFIPIAQILSKPPYEHRVRICTHPAFKDFVEAQGVEFFSIGGDPEALMSYMVRNPGLFPNRKSVRAGDIGKRRAEMWEIINGAWRGCTEAGNGMGEPIRATDVENVEDLFLADAIIANPPSIAHIHCAEKLGIPLHMVFTMPFSPTSAFPHPLASMNYAGADAKTANYLSFVVMELLMWQGLGDLINKFRRKLALDPISVMWGYQLLSRLRVPFTYLWPQSLIPKPPDWGSHIDIAGYSFLPLASSYTPPPDLLAFLEDGPAPIYIGFGSIVVEDPDALSELIFGAVKLAGVRAIISRGWSGVGDKCEVPKEIYLIDNCPHDWLFQRVSAVVHHGGAGTTAAGIAAGRPTVIVPFFGDQPFWGKMIARSGAGPEPVAFKALTKEILAESITFALTPEAQEAAKRMAEEISQENGAEDTAKRFQDRIGLDKYECEICPGRLATHWHKKTRTRLSGFAVACLVDRGLIQPPELELIRRKNWYVDEGVEHPLVGFVSALTGPMMDYTTATFDYTHALKSRPKHAPAPPEGRRQSWLDPWAEKTENGSIASNGTSPSRRINPTTFSRREMELYASRVARKSIKTNNADIDTLIRAPTLYDKQKAAWLARERGRNGRIFYLTRATGRYASELTKVTLKVPVAFFYNIANGFHNYPSVGFAGVEVRRRDQINDLESGLAAAGKEFTLGMWEAFSGVVVWPYKSIHEEGAKGIGKGVWRGSKGFFSNLGASTFGLPGYTLKGVERELQKHHLTNCKAEVILIRLRQGIEAFRNATPRERDRVISRWNKHLKKKGF

SEQ ID NO: 7843 - protein, 436 aa, Devosia sp.
MKRIALVTIGTQGDVQPYLALAIALKERGYSVVLGASEEFQDMVEGYGVEFHTLGPSIQAFLLQQRFENAMSQSMLINGPSLLRQGQQIVDTAARHAWNMCQGADMLILNMNTSFGIDIAEALHIPAVMVALQPLNSTSEFPLCIYYGADFGPAFNKLTYTAMTVQQIYYNLPRNKLRRELMGLDSRKKGGFFRNTDGTPLTTLYPYSPEISPRPRDWPKSAIVTGYWQLKDRTDWQPSEAFQKFLSEGEAPVYIGFGSMPFGAERNTKILKEAVAMWGGRAVVARGWGGINPQDLPDTIFAIEKAPHDKLFKYVSAVVHHGGAGTTSAGLHLGRPTFVVPQTVDQPYWGRRIYELGCGPKPVRLRKLTSEILAGALADLTTNEDYRRKAADIAEKLHAENGTDKAITIIERVMANYVPAANKVKKARKPSLKLVG

SEQ ID NO: 7844 - protein, 1454 aa, Metarhizium acridum
MDNFPSLSPEGGGDGGSRQSAGADDSGGQRRISRNPFKKGHDDPSATLPDLPDLLKHSDSDDEDSPNDPASQRGRAMSVNMNQSIFGLIAAAGSRVDFNTRFDDGSSDEEDSEQSKSSNGSQDLSQTIILSPRDKDARRGHKKKLSSGHRLLKSLSTLPKRKSKKREASRLSAPLMGSSDEARESADLATSAMAQDNEDDRLPPVMSRMLQARAEIASRPSFDMERRSSDLAASGDSDESSALAKRLMEIFEFDEPEQVIEEYPCWLLQSVLLQGFLYITSKHICFYAYLPKKANVVAKSGYLSKSGKRNPKYHRYWFRLKGDVLSYYRDSTNLYFPHGQIDLRFGISANIVDKDKDNLQFNVITSHRTYNFKADSAPSAKEWVKSLQRVIFRSHNEGDSVKISLPIDNVIDIEETQMMDFSDTCKIRVVDNDETYAIDEYFFSFFNLGKEAINVLKILVEDASSTKRTPGKLIAEQELQSHEQPEKNSNSQPSLQNSTHPAELNPHQAMHVDKIRTTKLPEAVKATLSPMSPHSANPSPRASVEFSSRTSLDAIRYKGRRSHEVSSMMSEQSTRRSFSGHRKTQSTRQFDERRGRHIMDSSDSNLHSSTDDPSYSNLVVSVATEDPSASQILKGSEVFHSPTMRRSDGSSQSTDAREEELSKNSEIFPDASVSMKHAATTGSINQVGCHGQADQARSTTPTLQSITKMGSYPLQRAGAFADYLNKTSKRMSSLLATESMGYVEKVSGMWKGGRKHYGEPAGLRPDEDELEEDSEGKVQTSMERFRAHFALPESEKLQATYFGCIIRVLPLYGKIYISDRSFCFRSLLPGTRTKLILPLKDIETAHKEKGFRIGYSGLTVVIRGHEELFFEFSQVDVRDDCTVTLIQSLETNRYLREAGLLDLEEHEEEDQAMAERDALKSARQEDFPQHEILPPQQADSQPNVPTILMDETDGSFLTFKPPQPMRITCLTIGSRGDVQPYIALCKGLLAEGHKPRIATHAEFQGWIESHGIEFAKVEGDPGELMRLCIENGTFTISFLREANSAFRGWLDELLDSAYQACLGSELLIESPSAMAGIHIAEKLGIPYFRAFTMPWTRTRAYPHAFIMPEHKMGGAYNYMTYVMFDNIFWKATAQQINRWRNKTLGLPNTSLEKMQPNKVPFLYNFSPSVVAPPLDFSDWIRVTGYWFLDEGGEYEPPKELSDFIQKARDDGKKLVYVGFGSIIVNDPVKMTQEVIDAVLKADVRCILSKGWSDRISPKDDPAKPRPDEPEMPAEIFVIKSAPHDWLFRQIDAAAHHGGSGTTGASLRAGIPTIIRPFFGDQFFFATRVEDLGVGVGLRRWGANSFGRALWQVTRNERMIVKARVLGEQIRKDKGVDTAIQNIYRDLEYAKSLIKGKVGRYGQPDAEEDEDTEESWTFIGSDEPDPEMVTKKLSEGLGGVGKEKTFGSQAIKASS

SEQ ID NO: 7845 - protein, 679 aa, Ustilago maydis
HAYLYRVLPVAGRFFVAEHHLAFRSSGIAAKTVGRTLMLVPLHDVISAAKHVAFRPGHHGMVINISGHEELFIEISSAHRRDELLGLIEYQLELVRGGRESRISHEAATRERSNALVLRDLSERIHDGPATASMASSANSSVLSQTGPGFDNQSTSLSQLEEGSSVLSFAPTAPLTFTMLTIGSRGDVQPYIALAKGLLADGHRVRIATHAEFGPWILGHGIEFSEIGGDPAELMRICVENGTFTVSFLREGVTRFRDWLDDLLASAWRACQGSDVIIECPSAIAGIHVAEALQIPYFRAFTMPWTRTRAYPHAFAVPSKKAGGNYNYMSYVIFDQMFWRASAFQINRWRKKLLGLKPTSFDKLEQHKVPFIYNFSPSLVPRPLDWFEWIHVTGFWFLDNPDNSSSKKWEPPVDLVEFIRVARENKRKLVYIGWGSIVVPDAAAMTRCVLQAVKKSGVCAILSKGWSDRLSSDPSTPIDASISADVFQVSSVPHDWLFPQIDAACHHGGAGTLGASLRAGLPTVVKPYFGDQFFWGQQIESLGVGSCVRQLTVDSLAKALVRATSDKKQIDRARRLGEQIRTEDGVGDAVKAIYRDLEYATSLIKRDTRIEHMPMVTRTRTTDTALARRGKDTSVAVQDENDEDGHTSDEWSDIGGGSESSPRDETEVPRSSLILNRLP

SEQ ID NO: 7846 - protein, 1677 aa, Stereum hirsutum
MSRLSRSQMSIPTLASLAASASAPSTSSTPDDPAATQDRSNVVRRVMEKTADKLSRSKSLERRGQQGPSSKQPTSPRRVFSITRKGKEKQQPGDDARPSSLSKCSTPSTPSEPDESPFIRPPSPTQPPRRPSLQPFTGDGSMRAGTQTLIQALQAIPWEEDQDNEDDPLPNNLDPVDSDSDEDERPGQAMASSIHAIHRPVVMSRRQGSQLGLYSPITAASTKFNPSLPNVSTSPDTIGRSPSDEEEEEELEEDFEAAPTPGPGHASPQGMHPMEDARAPMSALLEDEIGATAARMASERTNSLATVATVKTVKVNRRARLAAKLADVFELSGINEVIAEMPCWLLRSVLLQGFMYLTNSYVCFFAHMPSREDQVLKSGSLYKKAQRTKRWIKHWFILKNDVLSWYQSSADPYFPHGVVDLRYAIVCEPVGEKGIRLRTNAKTIHLTADSVPSREEWVKSIRKVIFKAQNMGDSVKIAIPYSTIIDVDKSSAMDFSETIEIKVVEGLSASEELSVDSYFFAYFHDLPAALEQIRDAIAMYSLRTRRSELAGGEGEEGGGGEMLIDTTSPRSPPQSNRNSRLVEEAGQGQSGQGQTGGAVASKTSSPFRLASFLRPFQEPTTTTTTTTQVQVPPQTPRSTISAPATAVTPDLDTSEEFTHVRKRSSQSFIPITSSPPPSSAGGEFPWSTPPLSGSPGSAAMLPQSASETGLQQSVGSLTPTPSTIGVGGGLGLTSTTGSPTPPHLHPHGHTYPPATTADALSMPPVGGSFMSTSSSGISSNNGGAAGTAGTRPSAFAWGVGVPSWLKIPSRKSLVGPFGVGGGSGGVGGSGGEQGKGDMEGKGVSEVYTSTGSAVGDTGGGDTGSGSGQLAGSVGGGGGGGDMTFSILETPDWEVEAEMAGKFRNDFAFDERERLLGYFPGYIFRLLPVYGRLYISSNYLCFKATGPLATKTRLMLPIRDILATEVSKAFRFGHYGLVLIIKGHEELFFEFGLQDRRAAFVHLLNRQMEDVRARILSSAATSNAETPTTATGTGALSSSPLNNSFNGTVNASPRSKPDALFLEEFAPLRDSEEATAAGSGSGADPRPSMTDSLPAVMFTSTSSTFLTFKPKESLRFTFLTIGSRGDVQPYISLAKGLMRDGHRVKIATHGEFQGWVESYGIEFGYVGGDPAELMRICVENGTFTVSFLREGVAKFRGWIDDLLKTAWDACQDSDVLIESPSAMAGYHIAEALRIPYFRAFTMTWSRTRAYPHAFAVPERKMGGSYNYMTYVMFDQVFWRGTASQINRWRRNILGLPSTSLDKMEPHKIPFLYNFSPTVVPPPLDWPEWIRVTGYWFLEDASASASKWTPPPDLVEFIDNAHALGKKVVYIGFGSIVVSDPKAMTRTVIEAIVQSGVHAILSKGWSDRLTKNVAEVAEPEEPLPKQIYPLASVPHDWLFKRIDAACHHGGAGTTGASLRAGIPTIIKPFFGDQFFWADRVEALGVGSGVRKLTVESLAEALGTATTDERQITRAKVIGEAIRSENGVATAIEAIYRDLEYARSLVKGAVSPDDVIVEGTSPSSGSPGGSGGGDTEDESPDHDKLLSSPPSGSIGGAPSEDWSVISDLEEPSRLSLSSTSRQSEGRERRISFKRSGITATMLSVLPGALTTPAVQLTHRRSRSDGSCSASTNGRPSSSHS

SEQ ID NO: 7847 - protein, 1417 aa, Rosellinia necatrix
MASHPDEDATRRRLSRKTLKKQTGGRRPTLDFPDRFKELRDDADEDVLPPSQGPSMFMNPNQSIFGIIAAARSTVDFNDRFDGQSSDEDDNDDDENDGDVTGKAKGRRKKYEHVAKTTILKKSSSGKEEGSIDKKHRRRISEQLLQSLPHLPRLATHSLSQRSKLTPPRSFDTKLSVDNKMPASPVAEPQSPLLEADTADREERPAPIMSRMLEARAEMSSRPSFDLDGLSRDQQNQKGETGPSALAQKLKEIFEFDQPEDVIEEYPCWLLQSVLLQGYLYITAKHICFYAYLPKKVHEVAKSGYLAKSGKRNPQYNRFWFRLKGDVLAYYRDASNLYFPHGQIDLRYAISASVTDKDQDAVNFSVVTHHRTYHFRADSAPSAKEWVKSLLRVIFRSHNEGDSVKISLPIENILDVEDSQMIEFADTCKLRVIDNDETYSIDEYFFSFFSFGKEAISVLKLLVEESSRRHSGDNEHNAVRGSAVVAPTLHENVKATLSPPSRTHQEPSSRSSSDIIRDAFHTSGRRSLDLEHDRSQRSFSRCRTPSKGHQRGSSASREIRGSPDSCVQSLEDPSLSGLLASSNEDPSGSQILKGSEVFHRPIIRHGDSLSRVSDAIGPSDKPRAHERQPEASQQLPHPMTTGHVNDSITGEGPDRVTTPTLQNLTKIGTYPLQRASVLASYLNHTSRKMGGILATESMGYMEKVSGMWKGGRKHYHGTPGLRIDEAEDDEDDGTDGKHTTAMERFRAHFALPETEMLRATYFGFLLRVLPLYGKVYISDRHFCFRSLLPGTRTKLILPLKDIETTDKEIGFRFGYSGLVVVIRGHEELFFEFNQADVRDDCAVTLLRSLESTRYLGDAELLEDSPGEKDDALAERDALNEARLLEGTEHELKMPQEASGLSDSSPTILFDDPKASFLNFKPSESLKITCLTIGSRGDVQPYIALCKGLLAEGHKPRIATHAEFREWVESHGIEFAPVAGDPGELLRICIENGTFTWAFLREANSNFRGWLDGLLASAYSACQGSDLLIESPSAMAGIHIAEALNIPYFRAFTMPWTRTRAYPHAFVVPEYKLGGAYNYVTYVMFDHVFWKATAHQVNRWRNNVLGLPNTSLEKMQPNKVPFLYNFSPAVVAPPLDYSDWIRVTGYWFLDEGQEWTPPKDLREFISKARKDGKRLVYVGFGSIMVPDPAKMTQEVIDAVLKADVRCILSKGWSDRLDKAQASVPEHALPPEIFQIKSAPHDWLFRQIDAAAHHGGSGTTGASLRAGIPTIIRPFFGDQFFFGSRVEDLGVGICLKKWGANSFAKALWEATNSDRMIVKARILGETIRKENGVSMAIQCIYRDLEYAKSLVASKAGKNAAAGNADETIGDDESEEEESWTFVGGDEIDPELMVKNVLAEMESNNNASRLFGASSSTGSS

SEQ ID NO: 7848 - protein, 402 aa, Glycomyces sp.
MRVLLSTYGSRGDVEPLVGLAARLRELGAEVRVSAPPDAEFTKLIEGAGAVHVPVGRNAQDMVKGVTIGAAKDARQLAAEVVAMRLDMLDAASDCDALLATGLLPAGAREVAERVGIPYVFAAFAPRTLPSPHHRPHRRPGRPFPPGETDNRVLWDIDAANVQDMYGEPLNAHRASVGLAPVANVRDHVYTDRPWLAADPVLGPWPETPELDVVRTGAWFLPDERPLPADLEAFLDAGEPPVYVGFGSMPRHVLEDTAEVTIAAVRGLGRRALVSRGWAELAVVEAAGDCFAVGEANHGALFPRVAAVVHHGGAGTTAKAARAGAPQVVVPQMADQPYWAARVAEVGIGAAHEEPTPTVETLSAALETALDPRTREKAAAFAAQMPVDGAAVAARLLTDLIR

SEQ ID NO: 7849 - protein, 1436 aa, Fusarium oxysporum
MASQADDAPAQASIGAGDIKEHVHEELHRRKRQNSTATVFPEPLRESDAEDEEEDDTTQGPPMFMNMNQSIFGLIATASSRVDFNDRFDGMSSDEEGEGSSSQHSRDHIAQTSILQPGGKGKDKGHRRKRLSEHKLLRSLPALPKLRSRHKSQPSRLSAPVETADESDVEDNGTLSPAPALTLTRQDTQGVMSRMLEAKADLSSRPSFDLDRLSSDVSRSSDGEVVSALAKKLKEIFEFDTYEQVIEEYPCWLLQSVLLQGYMYITSKHICFYAYLPKKANEAVKSGYLSKSGKRNPSYTRFWFRLKGDVLAYYKTATDVYFPHGQIDLRYGISANIVDKDKEGLHFTVETHHRTYKFKADSAPSAKEWVKSLQRVIFRSHNDGDSVKISLPIKNVIDIEDTQMIAFADTCKVRVIDNDETYAIDEYFFSFFSFGKDAINVLKILIEASAESRSAEKAVSSREENESSQSPSGRTSMAASRHLPQIDRLYTGKLPDAVKATLAPMSPLSPHSPSQLSPRASMDAPRSSFDGFRRFGRKSMDVPSSIGDFSPRRSFSGTRRSTSRHQHGSTTPKQQQAQDSGDSFVHSSIDNPSISTLSPSSFEDPSASQILQGSEVFHSPTMRRSASASRKRDQSGKKTPRNSTSNRERPRHIQHAATTGAMQEMGGETSDSQRPVTPTLNSITKIGAYPLQRANAFAEYLSRTSQRMGSMFATESLGYVEKVHGMWKGEHRHYDEPQELKTDDDADDIDSDAEDKTQTAMDRFRAHFTLPESEKLVATYFGAIFKVLPLYGKFYISDRSFCFRSLYPGTRTKLILPLKDIENVHKEKGFRFGYYGLTVVIRGHEELFFEFRRPGLRDDCAVTLHQLMETNRFLEKSGFLDQEEQDDEEAAAAIAERDALKAARQDEFVNHELELPRETSGVSNAPTILFDNPNSSGLAFKPQKSMKITCLTIGSRGDVQPYIALCKGLLAEGHKPRIATHAEFQGWIESHGIEFARVEGDPGELMRLCIENGTFTWAFLREANSTFRGWLDELLDSAYTACEGSELLIESPSAMAGIHIAEKLGIPYFRAFTMPWTRTRAYPHAFIMPEHKMGGAYNYMTYVMFDNIFWKATAFQVNRWRRKTLGLPSTNLEKMQPNKVPFLYNFSPSVVAPPLDFSDWIRVTGYWFLNEGGDWEPPQELQDFIAKARADGKKLVYVGFGSIIVKDPAKMTQEVIDAVLKADVRCILSKGWSDRISPKDDPSKPRPEEPEMPPEIHVIKSAPHDWLFSQIDAAAHHGGSGTTGASLRAGIPTIIRPFFGDQFFFATRVEDLGVGVWVKKWGTNSFGRALWEVTRNERMIVKARVLGEQIRSESGVDSAIQCIYRDLEYAKSLIKRNAGKAAQHDANEDDDTEESWTFVGRDEPDPDAVTKKLSEGLVDTEKPLSLGSQAPSTAAA

SEQ ID NO: 7850 - protein, 1440 aa, Fusarium avenaceum
MASQADDAPAQASIGEEDIKEHVHDELQRRQRQNSTATVFPEPLRESDDSADEDDGPTQGPPMFMNMNQSIFGLIATASSRVDFNDRFDGMSSDEEGEGSGSQNNRHEDIAQTSILQPAGKGKGKANRRKKLSDHKLLRSLPALPKLRSRHKSQPSRLAPVEADDESDGEGSGALSPAPALTLTRHDTQGRLAPVMSRMLEAKADLSSRPSFDLDRLSSDVSRSSDGDEVTALSKKLKEIFEFDEYEQVIEEYPCWLLQSVLLQGYMYITSKHICFYAYLPKKTHEAAKSGYLSKSGKRNPSYTRFWFRLKGDVLTYYKNAADVYFPHGQIDLRYGISASIADKDKEGLHFNVETHHRTYKFKADSAPSAKEWVKSLQRVIFRSHNDGDSVKISLPIKNMIDIEDTQMIAFADTCKIRVIDNDETYAIDEYFFSFFSFGKEAINVLKILIEASSGSRSAEKAVSSLEDNDGTESPPGGASLAASRHGSNMSKLRTGKLPETVKATLAPMSPLSPRSPGQMSPRASIDGPRSSFDAFKRFGRKSMDIPSPIGDHSPRRSFSGTRHSTSFHQHGTTTPKAQDSGDSFLQSSMEPSISTLSPSSFEDTSASQILEGSEVFRSPTMRRSASASRKRDQSGKRTPRNSSSQRDRPHPVHHAATTGALQDMGGEQSGSQRPVTPTLNSITKIGAYPLQRANAFAEYLSRTSQRMGSMFATESLGYVEKVHGMWKGEHRHYDEPHELRTDDDGEDMDSDTDDKMQTTMDRFRAHFALPESEKLVATYFGAIFKVLPLYGKFYISDRSFCFRSLYPGTRTKLILPLKDIENVHKEKGFRFGYYGLTVVIRGHEELFFEFRRPGLRDDCAVTLHQLMETNRFLEKSGILDQEEQDDEEAAAAIAEHDALKEARQHELADHELELPHEISGVSNAPTILFDNPNSSGLAFKPQKSMKITCLTIGSRGDVQPYIALCKGLLAEGHKPRIATHGEFQEWIESHGIEFARVEGDPGELMRLCIENGTFTWAFLREANSTFRGWLDDLLDSAFTACEGSELLIESPSAMAGIHIAEKLGIPYFRAFTMPWTRTRAYPHAFIMPEHKMGGAYNYMTYVMFDNIFWKATAYQVNRWRNKTLGLPSTSLEKMQPNKVPFLYNFSPSVVAPPLDFSDWIRVTGYWFLNEGGDWEPPQELQDFIAKARADGKKLVYVGFGSIIVKDPAKMTQEVIDAVLKADVRCILSKGWSDRISPKDDPSKPRPEEPILPPEIHVIKSAPHDWLFSQIDAAAHHGGSGTTGASLRAGIPTIIRPFFGDQFFFATRVEDLGVGVWVRKWGTNSFGRALWEVTRNERMIVKARVLGEQIRSESGVDNAIQCIYRDMEYAKSLIKRKAGKNTQHDLAEDDDTEESWTFVGRDEHDPDAVTKKLSEGLVGLGAGSDRPLPLGSQAPTSQTT

SEQ ID NO: 7851 - protein, 731 aa, Wallemia ichthyophaga
MRTNSRVCETYEEPSNRSAQRSRSRSNSAESDDEFEDVGSDFSVLEHSEGTEDVLRAEEDIQQKFNAFFALSEERILGHFNCALFRMYPVPGKVYITDNYLCFRSLQMLGKTKMILPLSDLQAVQPHKPLRFSFHGLIMIIHRHEELFIEFTTANRRDACEKLLSTQLDRLVKNPALRHTQSSKGLKEAQIIEDLSLSYRRPSQTAPVPDEDGLSASTSVVSFQPTKRLRITCLTIGSRGDVQPYIALCKGLIKEGHECRIATHGEYKEWVEGSGIEHREVGGDPAELMQICVENGTFTLAFLKEGLSKFRNWLDELLRRSWEACQETDVLIESPSAMAGIHIAEALKIPYFRAFTMTWTRTRAYPHAFAVPEHRMGGSYNWMTYTIFDQVFWRAISGQINRWRRSTLGLKGTNLQRLAQHKVPFLYCFSPTLVPKPLDWNEWIHVTGYWFMDSFNTNNEENRKGLESEDHQDMLEFVDEGRRLCKKVVYIGFGSIVVSDPDEMTRIVVEAIENAGVYAILSKGWSDRMHTDKKKEEPQLPKCIFSINTVDHAKLFPLIDAAVHHGGSGTTGASLRAGLPTVIKPFFGDQFFNADRVEAANLGASVRKLTVDTLSKALKDATTDKKQIANAKTVGEKIRKEDGVGTAIKCLYRYMDYAQTVVTARAKEHDDIQDDSNMENHDTDDNDDDWTLTSENISDGEIHDSVGVLSLASNIGKRSLGVGKDLLSKKS

SEQ ID NO: 7852 - protein, 802 aa, Aspergillus nomius
MKPLQRSKSDDLADLVDAPPPYTLIAEAGSSTVQDDGRIDVDLDSATARTALRFIPRLSEDDLIHPPPTYSGPVQCDVKLNVVIHVVGSRGDVQPFIALGSELQKHGHRVRLATHDVFASFVRKSDLEFYPIGGDPAELMAFMVKNPGLIPNMKSLRAGEITRKRMMVREMLEGCWKSCIQNDPSTGAPFVADAIIANPPSFAHVHCAQALGVPLHLMFTMPWSSTSEYPHPLANLKYSGTNARFANAVSYGVVEWMTWQGLGDVINDWRETIDLEPVPLTEGPSLVQTLKVPFTYCWSPALVPKPKDWPSYIDVCGFFFRELPIYSPSSELDAFLRDGPPPVYIGFGSIVIDDPPRLTSILEEAVRAIGVRAIISRGWSKLGGSSSKDILYIGDCPHEWLFQHVSAVVHHGGAGTTACGLRFGKPTAIVPFFGDQPFWGKMIGASGAGPEPIPQKSLTAQSLAEAIQYCLTPQAKEAAKDISNKMQYESGVKAAVESFHRNLPLDRMRCQLIPDQPASWIYKRSTKPILLSKLAAQILLNHLRIESRNLQSHEIRPIIITNRRYDPITSTTSATIGYGTDILRATSDMFVKPYQELKGRSATAPAATNAEDPLSKVDSQTTTANTVDWNATGAAIGAGAAGFGKFMKYVYKGVIVDIPLAATEGLRAVPRLYGEEVEDYAIRDWKSGAIAGGKNFTQGMREGFTDIFTQTQKGAMEEGAVGMAKGFLKGTLSIGTKVPSGWLALSLFTNLADLAQLHLVSWLSSSWNNQEPTLGDEVKDQEANHPSAASGGPIYSAKGCKA

SEQ ID NO: 7853 - protein, 1365 aa, Mortierella verticillata
MSLKEHVVKPPTSGSAFLQFVAAALRSESMVGSQQRSEYSEEEDDMVHVNKDGKDKTPHHRMLLRQESTHGLGIHSEGEEDEEDFSDEEGHRLRHHHSEHHPRHHQLHMSQTTHSKDDGDISKSTSGISFGSIRDKKTVAEKLQAAFGYAEVEEFIGEYSCWLARSVLLPGYMYLTTNHICFYANLPSSQDVVQKEGFFSKKSKTTKQFTRYWFILKNDVLSCYSNQTEVYYPIKTIDLKNALSAEPTAHNDQTFYIFTNNRKYTFKTDSELVRTDWVKAIQKSIFHAKMEGDKVKISIPLANVLDVEMNTMAFAEAIQVKVMESDESFAVDEYYFAYFDKTAQTLATLKAQVKNFHQKHSQDPHRDRRIYDSTSPNVNSPRKTPATTFTSITDVPHHRPSSLSGSRTLFQSPSGSKRDSLKLLNPDHNKPASRSSSPGYKSQPTSDTEENDKDKDKSRYGLSFSIRGTTSWIADHKPDFGGSDDHMNLNEKEQEAFRKEFSLPDTEGLSAVVSGYLLRILPLYGRVYLSDNYICFKSKLYGTRTKVIVPLADVEQVNKHKGTRFYFHGLSLLTKTDDEIFFEFSTTETRNTILNTLLDRITPEAQERRFKQRIQSIAETPSVELDDPMGSRLSDSLQLREEPVHVDHMSWASHPGFKPSRPMHITCLTIGSRGDVQPYIALCKRLMQDGHTCRISTHAEYKDWIEGHGIEFGLVGGDPGELIELCVENGMFTVSFIREGLKRFRGWLDELMETAWTSCQGTDLLIESPSAMAGIHIAEKLDIPYFRAFPFPWTRTRAFPHPFAVPEHNLGRGYNYMTYVMIEQVFWKGISGQINKWRKDTLGLGPTSLEKMEAHRVPSLYSWSPNVVPAPMDWHSWIHVTGYWFLDNPDLKWTPPDDLVAFLKADPKNKPVYIGFGSMVVPDPDGMTRIIIEAVVKSGVRAIISKGWSDRLTTLEGGTTATPKKSEEIVIPPSVFMLKSVPHDWLFPQLAGCVHHGGAGTAAAGLRAGIPTVIKPFFGDQYFWGQRLEEAGVGVWCHDLTVKKLTTALVTITTDEKMIRKAHAIGEKIRSEDGVGDAVNYLYHDMMLAKQRLNKNRKDKSEDTPVKFSVRKDEDEDDWWLVQPSSGTSGATSGGEGSESTAGLNVLSGSETESSSTPSEDAQIAFPELIHSLSHQASGSEPMSSHVQTSATEPGPDRSTRLVTNSDESAEVVAGQLEALNPPSRSPVPFFANAFGHGESVPKDRGSTPSSSKSAKRTSTARKVIDSLTSKATNMTGYFSPQLSAHGSHSNQPSPRASMDGHRTSSIGSEHGDFGEHYPSSSSSSTSTAKPPSSSKSTKSFTTDNSGSNEPSKQVTKLTTTHHLR

SEQ ID NO: 7854 - protein, 1205 aa, Saitoella complicata
MDHLNLGEPVTAPSATAPLSTATFSSSIPPPQQPMQAAYTSTSGFETLRSRMSDLALSENCSPTTSAPPKTDTDTDTDTAFRTRLANIFGWPSVPQSVVEFPCYLLKSVLLQGYLYLTPHHLSFHAYLPRKDDTILKSGTLSRKSSRGLRWKREYVLLKDGVLSGFASSSDLYFPTHLVDVARAVHVSGDGKEIRVTMQGGKEHVFGADSELGAKEWVKAMQKVVFCAHNPGDAVKIVIPLPNILETESVPASTSSEETEGVSGASFGSDGIRVKVVLDDETFLIEEYFFAFFGGWEEAVKMIGESVERSNGGQVNGEDGAGVGERKLRESVRDTTASLGSKAGTPTTLGGDDDSSSSSADDDDDDTEGDAAKTNALPTKKSHTIPLPKFPGMKLLGRTRTGHQGTHTTDPSEPVQHPALQRDVEEAITKGETSSRYGDDLGARREEFVGKHGGGGLGGLLRKGVGKIMGGGGASVSGAVPPMEGRQDGGVGGGGVSDVVEESHKFRSHFALPAAEVLLGTWQCYITRSIPLYGKLYASDRNLCFRSTLPGTKTRMIVPLRDVETVEPEKGFQVLYSGLVVLIRGHEELFLEFASEEGRDEARRVIEDAVDEALRDRTRSRLTVEEMDQANRDKEEHLFLAERHQKAHDARPPPENEGAGNDVPPIIFDDPGTSFVTFKPEGALRVTCLTIGSRGDVQPYVALCKELLKEGHKPRIASHAEYKDWVEGHGIEFMPVEGDPAELMRICVENGMFTYSFLKEASSKFRDWIDGLLKSAWDACQGSDVLIESPSAMAGFHIAEALGIPYFRAFTMPWTRTRTYPHAFVVPDHKMGGSYNYFTYVMFDNLFWKATAGQVNRWRKRTLNLGSTSWDKMDVQKVPFLYNFSPSVVPPPLDWPEWVKVTGYWFLDDPDSNKKKKWEPPEELTAFIEKARSDGKKLVYIGFGSITVSDPKALTKSVVESVVNADVRCILSKGWSERGGSEEKKDKDEVEVPLPDSMHQIESAPHDWLFPRVDVAVHHGGSGTTGASLRAGIPTVIKPFFGDQFFFANRVEDLGVGIGLKKLNVTQFTKALVEATNDEKMIARAKVLGEQIRSENGCQNAIQAIYRELEYAKSLIKTPQRHHAEGSSEESWDMMDDEEDETNYDEALAEEEQRASKHSLNPFKAINKMLQGVTQTHGSADDDEPDFADATSGRTDVEHQKFSDV

SEQ ID NO: 7855 - protein, 1261 aa, Zygosaccharomyces bailii
MPFHSSGGSDKNKKRPSLTDKHQGVSLSPTKSVLSGLGNVKHMGLELAPAFRVDTHKGDTENSDGHDTARGRYALKSIVGLLTAASVVCGMRDQQRASDVAQDLDDGEDEESYVDASSEPEENDERGSNKQEGEEAVDISRVQTGNEEKLSPETLTTGRSLGFDLSVEPLESASGYNSKLDESIKKDMIDRLVQHFDLGKDEFFAGDFPSFLLRDVLVQGQLFLTSMHLLFFAYLPSTSDQVQLSGNLNVHSRIRGSTRYWAVLRDQSLSLYNSPTEIYFPEMVLDLKTTVSIIAIQNKHTGKPTKSFKIETKRRSFTFSADSEFSAKSWCNALKRQHFAAQNADNDSVSLKIPLVNIVEVVNEPIVGNASTLRLKTLESSRGDAVIEFVFVFLNSSSAAVKKKVDTLIRNFERSGLPALSPTSPDQYSVISDSTDYSSAFDSPEKSDLNALSPCKSPGGHHHHLHLLPRFHRHHLQHLHMSSSCTNVEDNSAILSRDLSNSPSKQRARSTSGGSMVSPVKHVVGDVLRAPETFVQELNISIPSISVKSISQPTSSREQSASSLNADSSLADASNKNQAERESKKSHWHHRHLISELWNNKPLHYRNESVPFDDSDHYLVSPEDNERANSRFRKHFHLGEHAKLVSAYFAYLSRNVPLYGKVYLSDDMMGFRSLLPGTHTKMNLPLVDIEDCYKESGFSFGYEGLILVVRGHEELCFEFSSTEARDDAQHIISERMKLLKKENVTIMSPTTNILEIDSNIAKMKLIEDKINAEGIDAPLVLDQNPYYETSIKPEKKFKVGLLTIGSRGDVQPYIALGKGLQKEGHNVIIITHGEFRGFVESHGIEFDEIAGNPAELMSFMVEHESLNVGLLKDASSRFRKWIAELLVTSWKACRKAELDILIESPSAMAGIHIAEALQIPYFRAFTMPWTRTRAYPHAFIVPDQPRGGNYNYMTHVLFENIFWKGISGQVNKWRVETLHLDKTSLELMQQNKVPFFYNVSPTIFPPAIDFCEWIRVTGYWFLDEKQNYTPPEGLQRFINRARKLNKKLVYIGFGSIVVSNAKEMTQAISEAVVDADVFCILNKGWSDRLSDRSNKNEIEVPLPDCIYNAGSVPHDWLFPQMDVAVHHGGSGTTGASLKAGCPTIVKPFFGDQYFYATRVEDIGAGLALKKLNKKTLSRALKEATTSGKMKERAAMIKERISHEDGVKTAINCIYTELEYAKSLVVAKKKNNSKEGKNRLEIAKFSAPRLPELNLEKSFTFL

SEQ ID NO: 7856 - protein, 406 aa, Streptomyces silvensis
MTAGSRGDVAPFTGLGAGLVAAGHEVTLVTHGRFEELTAGSGVRFHALPVDPRAELHSERGRSLHRSRTGPGRLLRVMTMAKDAAAQMAPGLLAAAENSDALVVSGAVAPLGCTIAEGLGLPSVGVNLQPFYPTGVFPPPMTGTRSLGRTGNRLAGHAVLTLIERIFHDTARDLRTQLGLAPRTLAASRRAHEHRRWPVLHGFSPRIVPRPHDWRPGLDVVGYWWPHDTGRLPADLEDFLAAGPPPVYVGLGSATVPDPDRLSAQVVRALRAAGLRGVVQRGWAGLAATGDDVLTIDDVPHSVLFPRMAAVVHHAGAGTTAAGLRAGVPAVPVPIQFDEAFWAERLTALGVAPCAVPLRGLTTARLADALVRATEDPSHRSRAHALASRLATEDAVAPVDAALASC

SEQ ID NO: 7857 - protein, 1251 aa, Trichoderma reesei
MATPENQWNKPRRQPSSRPPPASEAVVTDGFVLPNLDVPADAPPAYGSHHDQLQFSRTGFEAGAILTADGRVNININTKNQRLAELLGPSIASQIAAQPSLPPAYTLPSLAGEPGKEPPPRLNVVIQIVGSRGDVQPFVALGQVLKDTYGHRIRIATHATFKTFVEENGLEFFNIGGDPAELMAFMVKHPGLMPGIDALKSGEIRRRRKGVQEMMLGCWRSCIEAGDGLGPPPEPHRRMEQWDPSAGMPGDPNHEPFVADAIIANPPSFAHIHIAEKLGIPLHMMFTMPWTPTRAFPHPLANIQSSNADDVLTNYLTYTLVEMMTWQGLGDIINRFRENALDLAPLSLIWAPGLLNRLKISYTYCWSPALIPKPNDWGPNIDVAGFYFLNLASSFTPEPDLAAFLEAGPPPVYIGFGSIVVDDPNAMTRLILDAIHLAGVRALVSKGWGGLGIDAVGVPDGVFMLGNVPHDWLFERVSCVVHHGGAGTTAAGIKAGKPTIVVPFFGDQPFWGAMIARAKAGPPPIPQKALTAEKLAEAITFCLQPDTQAQAQALGCKIREEKGTEAGSRSFHNHLNVDSLRCSVAPSRAAAWRLKRTKVRLSPLAAAVLVQRRLIQYSDLKLYRPYEYNTEDQPPDPITAGACSLVTDISDIGMAIVDMPLDILKSPRKAREAMGDAASQASGDDSDAASIPGSLKGRPGTKTPTAASAAETVGDASSVAPLGHSPSLPAEIDRTRSPTAGSGGGSRSSSRRRALSATTMEAAVGTSRNVGRIVTTGVKSPMNFCLGLAKGFRNIPRLYNDDTVRTVEKVTDFNSGVRVASKELGYGLYDGISGLVTQPMRGAQKDGAAGLLKGFGKGVGGLIAKPAAGFWGLPAYVMQGAYAELNKFLSRSVQNYIITSRVVQGERELQMASEGEKADIVNRWKHDAELGALYQRNAKGQERGHSRISSGDGSSFWRSPLSEGRRQLGAALGDSKQQQPSRTMERSYSPVRKSADTASVADTEYEAAIRASVMETSRGDVEEDAMIEAAIRESVKAMRQQGSLPDPVDLAATVKHHDLFEDEDYKITDEEYQNLIEQALRESLVGHAADPSVAQASSSNQELDAGKSAPPAYEGHTRSSGSAFTPMSDEDADLQRAIEESRRPPPTLPPRISPSQQVEDDEEEEQLRRAIEESKNEMERAQNKRTEEDIVLEYVKKQSLAEEEYRKQHLAKGKGKEVADAADDDDEEELRRAIEESLRLSGEGSSAPPEA

SEQ ID NO: 7858 - protein, 403 aa, Streptomyces viridochromogenes
MTAGSRGDVAPYTGLGHALSRAGHEVTLVTHGCFERLVAGSGVRFHPLPLDPRAELESARGRSLHRSATGLGKLVRVVGMARALAGQMTDDMLAAARDSDVLLLAGSTAPLGHAIAEGLSLPSIEVPLQPLAPTREFGPPMLGGGSWGAVGNRVAGHGVSLAIDRVFSAAVPEVRTRLGLSRTKPRTTRRGRALHGYSSLVVPRPSDWPPHLEVTGYWWPYDGAAQLPDELREFLDAGPPPVFVGLGSATVPDPARLSAEVVRALRRAGQRAVIQRGWGGLEAAGDDVLTIGEVPHSALFPRMAAVIHHCGAGTTGAGLRAGVPAVPVPVQFDEGFWAGRLVALGVAPRAVPLRRFTAEALADAVRRATSEPSFGRRARELADGLRGEDGFAPVLDAVNRIGG

SEQ ID NO: 7859 - protein, 405 aa, Streptomyces scabiei
MTAGSRGDVAPYTGLGHGLARAGHEVTLVTHARFEPLVAGSGVAFHALPVDPRAELESERGRGLHRSSTGAGKLYRAAEMARSLVGRMAGELVAAARAADVLLLAGTVAPLGQAIGRGLSVPSLGVNLQPLAPTREFAPPMTGVRSWGPVGNRMAGHAVNAAVEWIFKGEVRRLGTEYGLAPAGRAGALRGGDRPVLHGFSPRVVPRPGDWRAGLDVTGYWWPYDGEDLLPAALLDFLDAGPPPVFVGLGSATVPDAGRMSGEIVRALRAAGLRGVVQRGWGGLRGEGEDMFTVGEVPHSLLFPRMAAVVHHAGAGTTAAGLRAGVPAVPVPVQFDEGFWAARLVALGVSPGAVPLRGFTPTALAAALRRATTDPSYARRARVLAEELRGEDGVRPVLTALDRLA

SEQ ID NO: 7860 - protein, 988 aa, Rhizoctonia solani
MKKLKLHRSREYNTHAPPTDPVSGTALPMLRLVNDFVHGFVKIGSRRPDKGLVKMVTASAAGFQTTLQGMTEGLTNVPKIYGSEVRDSKKVTGLVSGVVEGGKGFAYGLYDGITDLVREPVKGYKEKGALGAVAGFGAGALNLYLKPGAGMFQIISKPIEGGVKDLRGLFHKDDSQRRVSTNPFESTISPYTTASHSQDSLHEAAAQPPPTYSPSVSGSTARTGMFITNGWPDLSVELLDSSAAGSSAYPREKVHLPEYHEAITTEATIQSDGRIQASFAPALGFPDGCVPPIYKPGLDEDSFLNAPAMNINIMIVGSRGDVQPCIALGQQLQEYGHTVRISTHETFRLITKSAGLMFFNIGEDLNELMGYMDCNAHLIPGLDSLMGGEVGKNHQIIAEILDRCLLSCYAEDESSQGEPGFAADLIISNPPTLAHIHCAEALGIPLHLSSTMPWSPTAAFPHPLVNVKQNDEAELGMANYYSYRLVDMMAWQGLGRTINKFRTKRLGLEHLSTQSAVGLTERASVPWTYFISPTIIPKPADWVSNVDVTGYCFLNLAKEYNPPRELVRFIEAGQQPIYIGFGSIVLENAENITKSIIAAVSQVGVRAIILTGLGELDESMIQVAGDDIFPLTTEVPHDWLFERVSVVIHHGGAGTTAIGLKCGKPTIIVPFLGDQPWWAVQVVRHGAGPPPIHPNKLTAEALAAAIRVAMSPETREVANQIGGIIRNEQGPKNAVESIHKHLPLLNMRCDLDPNRVAVWYSSAHKLRLSAFAAQVLAEAREIDINKLELHRSRERGAAKLPSQPGKGATKVLSASTLGVQSTFQGAAEGMHNLPKVYGGEVRKHKKVTGIGSGVVQGGREFALGLYDGFSDFFMEPVRGFKRRGVLGAIGGVGIGALNLTTKPTAGFMQAISMPIEGAVKEVKSLLHRQVGKDRIATRYAEGVSAARNASEAEREKVVRAFVERVSGNGSAWMVDKKGKGKAKMTWKN

SEQ ID NO: 7861 - protein, 1589 aa, Metschnikowia pulcherrima
MSTAGPQLPAVPKSGENRPQSVYTEAEPAHVQVPESSDWHDQIKSASRLLAMAMDRLGLEERHENLSKASPFYKKVSLAVFPPFKASLNYIHAQTEPGHAETTGNAEVHEEEDVALLVSDHQGLTSILSMLATALACAGATSLKAIGSILHDRYRDEDEGGSDSEGKQKGPESNSGEKAPVLQPHHSLHEEITQGKEPLLRPTSRLNGIRPLAGLGAPGGSLRKSLVPASLTGGTTDELRLMYLSEIMAKALRNGDYRPPPENLRSPWENSVMANHHVQSSGDHALITYETADDGLSGESPEKTEILKYHIALKLKETFAFEDDNYLYDHFDVWLVKDVLLQGHMYITRDAVCFYSLLPGKFSVKELNDPELTVHSGALGHKLAHYGDAFFLSVYTNRFWAVLKPTTLSIYTSPTKLYFPVRTIDLHTAISCEILEPTGANLQSAQNSPNMGTPTEPSMLQINSELASIALDDAHEENVQAGVWFRVTCTDKQYRFHTSSIYLARHWYNSISKAIFALRNTNAQREVIMRLPIEDIVDYKKNFVLSDAETAELQAVPSPQDDEAPISFSIKFNLPQSTEDSKVQKLKQKTKKIGDAHSLHDSAHFVAFQKGADLSRTFERALEENVLDSAEKNHKLKKRAKKFFRDDRTDSGSLHSKTAYRVVTTVQPEYLSSLSVIDKIVEVNAKILQARVKMEEQANETVDRGNEAEKKFSYVPNFKGMKDRLMPKTSPIAGLANLGDGLLDVFRQEDESLAPLQDFEIPDFDYHLQLPKPFSLQMLKNLDIQMVRKRRSFDDIAGQYGNLLEVIKEKRAKDKAFARQPIAEETEYDVAHDGSESRLEGRMGSPISETRGKLRSLKRLLRTVSTIGGVWSARPEHFDLVIGHDKYFIRSKREKVRALNRFRKHFSLGPDSHLVSTYFAHLKRTMPVYGRLYIGKDQVCFRSMIPGVSTKMVLPLRDIQSCKKQARLYHYAGLLLKIRGLEDLLLAFGSKDSRDDCQKMILKLLRKEDHFNPDSEFIQDNQLDSSMDIDETERQNKRSDELANLRIHAARLRLLEDKVSYATGIEMPLILEDNPFTTIEVKLAKCYRITLLTIGSRGDVQPYIALGKALVKEGHEVTIATHAEFEDWIRKHGIDFREVAGNPAELMLLMVTHGSISVGFLKEASTKFRGWIGELLESSWKACQGAELLIESPSAMAGLHIAEALNIPYMRAFTMPWTRTRAYPHAFLVPDQNRGGSYNFLTHVMFENVFWKGISGQVNKWRQETLGLPRTSLVKMQQSRVPFLYNVSPALFPPSVDFPDWVKVTGYWFLNEGSDEYEPPKELVDFLEEAKQNGEKVVYIGFGSIVVSDAKALTKTIVEAVLDSGVKCILNKGWSDKLSKSKDDIEVELPSQVYDSGMIPHDWLFTKIDAAVHHGGSGTTGATLRAGLPTIIKPFFGDQFFFASRVEDLGVGIALKNLNKKSFTKALKSITSQEKYAVKATEIAKAMSHERGVLSAVEAIYTELAYSRSLILVIRHNTEQKKSNDDKSGVQTPVIGEEDFDMINGMEDDEANEEQVREEHKGESKAKKDKADQKRVDGDIEDIKNQIGI

SEQ ID NO: 7862 - protein, 1352 aa, Thermothielavioides terrestris
MELPERLRDHGDQVDGEEEVLRPQGYGGGLFMNMNQSIFGLIAAAGSQADYADRFEGHSSEDEDEGERRMAETIAGPTALQPESSSARGLAQTTVLPRHDAHDAADVKAHGRHLRKLSESRLLRSVPGLARFAGKIRPSKSFKPKSDDGAQGAEATQSAPQPTPDLMPSIQITRTDSMMTAPARTPQAYDLDGSNESPQDAETSKTGPSELAKKLKEIFGFDKEEEVVEEYPCWLLQHVLLEGHMYITARHIAFYAYLPKKANEVSKKGYLSKCGKRNPKYSRYWFSLKGDVLSYYLDTKNVYFPYGQIDLRHGISAVITDGDKEGTHFTVSTDHRTYYFRADTAQSAKEWVKSLQRAIFRSHNDGDSVKISLPIENVLDVEETHMLNFADTCKIRVIDNDETYAIDEYFFSFFSYAREAINILKILVEDSSSHAHGLSDQVEPSSERTSTSGRREQASNLPHLRTGKISEGVRATLSPLSPVRGSSPSPRQSSDRPRSSFDRFRAFTRGSMDTNANIHPGSPRRRSFSHGRRSLSRKRHEGHERQESSDSYVQSLDPSQASLSAMVASASSEDASASQILRGSEVFHGPTLQHAGPSTRAGHHASDSKPPTRPATAPRQSTDAGETDGRATTPTLQSIATMGGYPLRKANALMGYLDRQSRRMSNLLATESMGYVEKVSGMWKGGAKHYDEPPELRTDEEDGALGPEEKAHSEARFRAHFTLPESEKLQAAFYAHMMRVIPLYGKIYISDWHFCFRSLWPGTRTKLILPLRDIENVDKEKGFRFGYAGLVVVIRGHEELFFEFGKAEVRDDCTITILQGLEATRYLRGSSLMDGGESEDAQAAVAEHNALEKARSQGFADHEVQLPRETSSVSEAPTIIFDDPKASFLNFKPSQPMKITCLTIGSRGDVQPYIALCKKLLEEGHHPRIATHGEFKPWIESHGIEFAYVGGDPGQLMQLCIQNGTFTWAFLKEANAKMRGFLDDLLATSWQACQGSDLIIESPSAMAGIHIAEALGIPYFRAFTMPWTRTRAYPHAFIMPGQKMGGGYNYFTYVMFDNLFWKATAGQINRWRNRMLGLPATTWEKLQVNKVPFLYNFSPYVVPPPLDYSDWIRVTGYWFLDEGGEKWTPPPALMRFIEQARADGKPLVYVGFGSIIVADPARMTQEVIDAVLKADVRCILSKGWSDRATNEKGDTVKAGAADDSSSKSSSKKAEPELPPEIFLIHSAPHDWLFRQIDAAAHHGGSGTTGASLRAGIPTIIRPFFGDQFFFGSRVEDLGVGICLKKWGANSFARALWEATHSERMIVKARVLGEQIRKVSRYLLSLVEHLFFPPFFLHNHPYPRHLSRTSQTR

SEQ ID NO: 7863 - protein, 1465 aa, Dothistroma septosporum
MASQSSILPDRRRSSGGVKTRFGSIKLAKVRSRERSAGPSTAAMDLPDRFKSDDDEDVDDGTGMAGQDGPMFAQQSMYGVLAATQGKANFRFQQESGSESEGEDEESKRKRSEDAVRPSAGGSGRSTPRQHERKKSSDSKKDKGEEKRRRRKLSETKLVRSFLKPVRERVDSNAPDPMSQSQFLPPRKEEAYEDLQPVPALARKDAPILDRKLQAMAKADMDSSRASLEGHKSKDGKTGDINMDRMPKTLPQVIANIFQFSEPEEVASEYPCWYLQNVLLQGYMYITQKHVCFYSYLQKRTNVTVKTGHLGKQGKHSYRFRQYWFVLKGDIFSYYKSSAEPYSPLGVVDLRYAITADVTGGAGKDYTEFTITTHERVYLYKADTGDSAHEWVKQLQKVIFRSHNDGDAVKISLPIKNVVDVEEASMVDFAETIKITVIADDETFATDEYFFSFFSLGKEALNMLIILTEGNEAKKTLADDSGMSPLTKARSSPTFDQSANVRSSPRPRQEPARSTLSPLSGRSSPSISSEGKRSSTDMTRPSLDDNKSTSDDRGGRSVSADSRGRYGVRGASKAPSSPRIDDSTESFVTSSEQPTDSSVDEDTMQANMTASTMLAEDGVFAGPTLRMPQPRRLVSGSTVEKLRRQSQHSSLESSAECAIVQSPSRQQPDQSLAHQPDIKRTESGGSGRTLEAERLQPSEAAATGRLARGISTPLQRAMTVAGMVRSSSVRMGSYLSSSPKTTLSNWSDAIAGGKRNYKDAEGLAPDDSIQDPEQEVDIAEHERRFQAHFGLPISEKLVSAFYAWLHKTIPVYGKIYMGTRRFCFRSLWYGVKTKVVIPYKDIINVQKQRGFRWGYPGMVLVIKGHEELFFDFPSVGLRDDAAVTVLRNLETVQDAATSMILTEEEQQEAEDAAAENASLQAARKGGSADHDLQLTPGLSERDAPPILFDDPSASLLEFKPEVSMKITCLTIGSRGDVQPYIALCKGLLAEGHKPRIATHKEFKPWVERHGIEFAEVGGDPAELMRMCVDKGLFTPSFVYEANSTFRPWLNSLLKSAWEACKGSDLLIESPSAMCGIHIAEALEIPYFRAFGMPWTRTRAYPHAFAIPNRKMGGGYNYMSYTFFDNMFWALISGQINRWRGKMLGIGPTSMDRLQQNKVPFMYNFSPSVVVPPLDFSDWVKVTGYWFLDEGEDWQPPEDLANFIDKAREDGLKLVYIGFGSVTVADSRLLEQQIIDAVLKADVRCILSKGWSDRFESEAQKALPPIEFPACIHQIRSAPHDWLFKRVDAVVHHGGAGTTGASLRAGVPTIIKPFFGDQFFFATRVEDLGVGIYLKKVTANQLGKALWIATHDSRMRGKATLIGEQIRAENGVRTAIDTIYRNMDYARSLIRKGGRQGSVTSQSGVEEETEENWTFVEKDNEAEAIAAFAQIEAAMMGQQPQPQPQGKSGNHGRQMSLGGMAMRGRH

SEQ ID NO: 7864 - protein, 405 aa, Streptomyces kanasensis
MTAGSRGDVAPYTGLGAGLVRAGHEVTLAAHAVFEPLVAGSGVRFHPLPVDPRAELHSERGRRLHDARTGAGKLVRLVSMAREAADDLTAALVEASREADVLLVGGALGPLGYAIAEGLSVPAVGLHLQPLHPTGEFPAPILGTRPLGTLGNRLSGRAVTTSVELVFAGSVRTLRRRHGLTAAGRKRGTRAARPVLHGYSELVVPRPRDWPAGLDVAGYWWPHETGRTLPRELEDFLAAGPAPVFVGLGSATVPDPERVSREVVGALRAAGLRGVVQQGWAGLAADGEDILTIGEVPHALLFPRTAAVVHHAGAGTTGAVLRAGVPTVPVPVQFDAAFWASRLTALGTSPGAVPLRRLTAGTLGAALRRATEDDTHRVRARELAARLAAEDGVAPVLATLDRLAR

SEQ ID NO: 7865 - protein, 424 aa, Saccharopolyspora erythraea
MRIAIFSFGTRGDVAPFTGLGARLREAGHEVVVGVHDSFAPMVREAGLEHRPLAADARALLAGEVGKRLRDYGSGVRGIAEQLRHVGDFTETMNELGESVVEAARDADLLLLQSGTLIHGYTVAKAMGIPSMLTELFPSQFAATGDFPPVKLGPVSFGRWGNRAVGRVMPVAAGPFVGFVKDFQRRMGVPSNGLAGLYREIERVRWPILHGFSPRILPRPSDWRPGIDVVGYWWPHWNPDWQPPAELVDFLESGPPPVFVGFGSMAQGEGERLSEIVTEAVRAARVRAVVQAGWSELTATGDDVLAIGDVPHEWLFPRMAAVVHHGGAGTTGAGLRAGVPAVTVTVLADQPFWADRLARAGVSPGWVRLKQLSAQRLAELIGQAVSDPAYRRRAREVADGVRAEDGAGRVAEAVAELATTTGKQ

SEQ ID NO: 7866 - protein, 1414 aa, Agaricus bisporus
MSQHCPTDSPLARSLSGRTKRLSFAVEKTVDKLSKSVAAKLPSQSPSVPLPRRRIFSLSRRSKPQSPERDNTVSPSSVPDSSDLLSVRATASETTVTQHDDCPFVCPPSPPVRPTLDTYCGEGSMRMGTQTFIQALQALPWTDPDNEEEGSSHEQDAVVSESEDEIEDNGRVDQLASSIHAIHRPLARSRKRDLPGKSPLAETVAEETENYLSDEEVEHDFEEPKTFEERPALIQSQSLPLPGNHGMNASMSLFTNTRRETMSTIRSHRRTRLAEKLRDVFELEGIQEVLAEMPCCLLRSVLLQGYIYLTNSYLCFFAHMPSREDQVLKSGSLNKRTQRTKRSLKHWFILKNDVLSWYQTSSDPYFPRGIIDLRYAISCEPVGEKAFRLRTSQKTVLLTADSIPSRDEWVKAIRKVIFKAQNMGDTVKIAIPYSAILEVDKSSAMDFSETIEVKVFDKEGNYLIDSYFFAYFHNLSAAIERIRDAVRNVRDVPEGELTPTLLDTTAARSSITVERSNTTSEVGTTRSSFSSFRLSSILRPISDTISLARSSGATSNPEPSIKAEDFTHITPRANSFIPITESPKSADIPTMLPSPTQETVEDAPNPQTQSLDHTYPPSIPPQSSCPDFPSFRSNSWAVGVPSWLKTRRMFSLGPQAQSLSASAGVKEVCSSPTVMPPVPTSKGGWGDMAFSILETPQIPIDSDVAEKFRTAFAYDEKETLLGYFPGYIFRLLPVFGRLFISTNYFCFKSSGQIIAKTRMAIPIRDILAVQKSRATRFNQHGLVVIVRGHEELFFEFGTEEKRDSFILLLERQMEDVRKRISAGDPVNSAGERQALILEELERKDSTASSVELAAHGPENMTDSLPAVMFTSASSTFLTFKPSQPLRFTFLTIGSRGDVQPYIALAKGLMADGHKCRIATHGEFKEWIESHGIEFGYVGGDPAELMRICVENGTFTVAFLREGLQKFRGWLDDLLKTSWEACQGTDVLVESPSAMGGYHIAEALAIPYFRAFTMTWTRTRAYPHAFAVPERKMGGNYNYMSCVMFDQVFWRAISGQINRWRRNILNLSPTSLDKMEAHKIPFLYNFSPSIVPPPLDWPEWIRVTGYWFLNDADVSAKKWTPPEDLIQFIDTAHQNGKKVVYIGFGSIVVSDPKTMTKTVIDAVVQSGVYAILSKGWSDRLHVKNSDTNEIEEPLPSQIYPIQSIPHDWLFGRIDAACHHGGAGTTGASLRAGIPTIIRPFFGDQFFWADRVEALGVGSGVRKLTVASLAEALTSATTDPKQVERARVIGEQIRSENGVATAIESIYRDLEYARSLIKRPVVEDAEEDDTEHSTIRNTDPSPGHTRSPSTTSGHSSTASLRAAPSEDWSVISDQEGQEGERNSPDSSPSNEGKGLRHSPMKRTSIAAAMLSVLPDL

SEQ ID NO: 7867 - protein, 444 aa, Nitrosococcus halophilus
MRIGIQTWGSEGDIRPFLVLGGALSEAGHSVTVVVTDLDDRDYSSYEERLGIQVRHVMTPVISSPTELERIGELILRENHPARQGKLIIDQLFLPTVPELYDAALELCSGSDLVIGHFMHYPLRIAAEVYGIPEFSVTLAHNLIPSRYIVPTGVPDLGRWANPAWWWLIKKLLNQMFLAEVNGLRRQAGLPLAKDLVTAWQSSKLNLVAVSSSIFPRQPDWTAEHQVCGFLGFSQARDKDSIPSVIEDFLAEGIPPLFMTFGSLTPKSDQAWPQTLELFVDTVRRAGCRAIIQGWPDSGVSVLLDNRILLCPPPLPHYLIFPHCAAIVHHGGAGTTHSTLAAGVPSIVVPHVADQFFWGKELKRLGVAPRPLLRKKLTAARLARRIQATIGSLAMGDRAAQLGQLLRQENGPINAVRLIQRAMGELGAKGSSTLSDTPSATTVD

SEQ ID NO: 7868 - protein, 453 aa, Streptomyces malaysiensis
MRILIVTAGSRGDVAPFTGLGRRLLDAGHEVAVAAHAPFSGLVRGCGLDHRPLPGDPRELIRARGRTASPGEARAVTAAFLDRLADGVVGAVADGTDLVLTAFGPAGLSRAAGEACAVPVIGTYLAPSFATREFPLPGASGAAGGPGALGVHGVPGGPGVPGGPGAPGGPGAPGDGGLGPEGNLAAGRELLVRAGGLQAEVLTRLRARLGLPATASPEPDAEIRPVLHGFSPLVVPRPADWPSQVDVVGYWWPARPRDWQPPAELTDFLEAGPPPVFIGFGSMAPGQGERLGELVTAAVARAGVRAVVQAGWAGLTASGDDVLTVGDLPHDWLFPRTAAVVHHAGAGTTAAGLRAGVPAVAVPAMADQPFWAARLHRLGVAPRPLPLDALTAESLGAAITACVTGTALRRRAADLAEAVAAEDGAAAVLAHIGAVGRGEAGHGDRTSGEPGAS

SEQ ID NO: 7869 - protein, 1553 aa, Neurospora tetrasperma
MASSQPTSSGPMLNSPPSPNPQSQPNSELSSSQHRANPSEAPTQAGPGPARPSALTKRPSHREVAAYRMSWKLQRLRGDSDQPHSPTMELPDRLKDNGKEEDNEEDVLQPQGGMFMNMNQSIFGLIAAAGSTVDFHDRFEGQSSEDEDDVPNHMAMTFAGPGIKGTARNRETAGTVKSLSQTVVFNKPPASATADAGPSNTHRRRPSGHKLLQSVPGLSRLASSHKSKKSKQHKGTAMADHKIEEEEDPDPSSPLPPLSKDETKSLGLAPPIEIVRAEGNGAPLMSRMLEARAEMAARPSFDLDRLSGEHRRDDAGVTGQLAKKLKDIFEFDTAEEVIEEYPCWLLQHVLLQGYMYITAFHIAFYAHLPKKAHEIAKSGYLSKSGKRNPKYNRYWFRLKGDVLSYYQDPKDHYFPAGQIDLRYGISASVNDKEKEGNYFSVTTHHRTYHFKADSARSAKEWVKSLQRVIFRSHNDGDSVKISIPIRNILDIEETQMVEFADTCKIRVIDNDETYAIDEYFFSFFSFGKKAIQVLKILIEDPSPEDSGANDAPKKTGGDGAIGDNLGSPRTRTFSEGVKATLSPVSPIQIASPSSRASGDYFKSSFDGTRPFSRRSFDASPGTAGYAGSPPRSLHGDGRRSFSKPRHEPHASTDSYAQSFDDPSQASLSALVASGSEDQSASQILRGSDVFHSPIFRRSASATRATTEGEGVAAPPIVRQHTAGLVRLHRPHHAATTGQIGDHMAEAQGGPSTPMLQSIATMGNYPLQRANAFMGYLDQQSRRMSNLLATESMGYVEKVSGMWKGGKKHYDHPAGRRTEREDVEDDPEERALSEARFQAHFALPETERLQAAYFGFIVRVLPLYGKIYISNRHFCFRSLLPGTRTKLILPLKDIETVDKEKGFRFGYSGLVVVIRGHEEIFFEFAKAENRDDCAITIIQSLDAARYLAESQEVEEAQAAEAERDALNQARNEEFPDHEIELPRQASGVSDAPTILFDDPKASFLNFKPSEPMRITCLTIGSRGDVQPYIALCKRLLEEGHHPKIVTHREFKDWIESHGIEFGPVEGDPSELMRICIENGTFTYAFLREANSKFRGWLDELLTSAWEACQGSDLLIESPSAMAGIHIAEALGIPYFRAFTMPWTRTRAYPHAFIMPGQKMGGAYNYITYVMFDNVFWKATAHQVNRWRNKYLGLPNTSLEKLQPNKVPFLYNFSPSVVPPPIDYSDWIRVTGYWFLDEGGDKWQPPKELTDFIAKARADEKKLVYIGFGSIIVSDPAKMTQEIIDAVLKADVRCILSKGWSDRSAAVDGVEKPKVADPSFPPEILQIQSAPHDWLFQQVDAAAHHGGSGTTGASLRAGIPTIIRPFFGDQFFFAGRVEDLGVGIYLKKWGVQSFARALWEATHSSRMQMRAEVLGGQIRAENGVDTAIQAIYRDLDYARNLITLKRQKHQSRRNSVATPTPGAKPNAPEDDQGQEAEEDDVDADDEEEENWTFVGGNEDDLTGSMSMSRSDMLSQTVADLRGVKVGKAPALGSRVLSSPSTSPGAMRGAGGVKYV

SEQ ID NO: 7870 - protein, 415 aa, Unknown
  Description of Unknown: Clostridiales bacterium oral taxon 876 str. F0540 sequence
MITILCSGSRGDFQPYIALAQQLKKLGKEVRITACKSVKGLIRSYGIDVYPIEADIETLKVDPKLLKAAGSSDNPLKMMFTFNKMKEYGIYMVNDYYSACEGSELIVYHPGCTVGYFAAEKFGIPSVLASPFPMHKTKEYLSVVMYGKTKSNALTKKISYSMIQGMLWMASKSSVKGFWKNNFGKIPDNFGCPFERHTDKKHPAIVSCSNFVFKRPEDWNENIHQRGYWFVEESYDYTAPKELEDFLKSGEKPVYIGFGSMTSLEQHEGLAEIAVEAIKKSGKRGVICSMGKPKDLPKNIIAIDSIPHTWLFERVSAVCHHGGAGTTAAGFKAGVPSIIIPFSNDQFAWAHRAYDLGVDAKPILKKELTSDKLAEAIKFALTDKIVANAKSLGRNIAKEDGALECAKTIVKCLER

SEQ ID NO: 7871 - protein, 1416 aa, Cylindrobasidium torrendii
MALQPTLQPILHDPDAAPPVDTSPEVLGIDVDSPKAVSGKRSVRLSSSFSGIGRNKSGRTPPGSPPASETKSPRRLFSLSRKGKGKSSERGDNEPSSPSSTPGASRPTSPLPNDDSSFNSPPSPPSANPRSLWGSFRGDGSVRVGTQTLIQALQAIPWTKDPDNDDEIMNHGGTVQASEDESEDDDRPGQSPPHMASSIHTIYRPIARLRRSTARDQRWNGLASHPEDQLPGLASEDEDHATRSEDEADDFEMATPRPAATPTAAPAPSIALSRSLRQGSMATVRLQRRAMLAEKLREIFELDDIEEVRAEMPCWLLRSILLQGYVYLTNSYLCFFAHMPSKEDQVLKSGSLSKKASRTKRWIKHWFILKNDALSWYQSSSDPYFPHGIVDLRYAISCEPSGDKQFRIRTNQKTVSLYADSTPSRDEWVKAIRKVVLKAQNMGDSVKIAIPYDAILDVDKSSAMDFSETIEIKVLDKEESGAFSMDFYFFAYFHDLPAALDQIREVVRTHRATQRDSSSTPRAVLDSTAPRTVLPSISTPAITDANYAKPSPSTFRISSLLRPFSERPVAQVAEPPVDLHEEFTHINTRSSSFVPTTESPVEDEEMTPRAGNQEYHHTYPPSTSLTSTLDPDIPSLTRREASSSWNVGVPGWLRGGRTSRLFGSYVTKPVKEIYSTTSSSVSGSRWSSVGGDMAVSVLDNPPVDIDPEIVDKFHTSFAYDDKERLLGYFPGYIFRLLPVYGRLFISTNHFCFKSSGPLTSRTRMALPIRDILSTEKSKATRFGHHGLIIIVRGHEELFFEFNAEDKRDAFVALLERQMDDVRGRVASGDLPSQGKFDALVVEEFESPSEETDDNMTDSLPPVMFTSTSSTFLTFKPQKSLHFTFLTIGSRGDVQPYIALAKGLKADGHRVRIATHGEFKEWVESHDIEFRNIGGDPAELIRICVDNGMFTLSFVKDGLNLFRGWLDDLLKTSWEACQGTDVLIESPSAMGGVHIAEGLGIPYFRAFTMTWSRTRAYPHAFAVPERKMGGSYNYMSYVMFDQVFWRATAGQINRWRRNILHLESTSLDKMEPHKIPFLYNFSPSVVPPPLDWPEWIRITGYWFLDDAEVSADKWTPPEDLVAFIDNAHALGKKVVYIGFGSMVVSDPKAMTRCVIEAIVQSGVYAILSKGWSDRLHVKSMEASEVEEPLPKQIYAITSIPHDWLFRRIDAACHHGGAGTTGASLRAGVPTIIKPFFGDQYFWADRVEALGVGSGVRKLTVDGLRDALLSATTDPRVTERARLLGEQIRAEDGVATAIEAIYRDLDYARSLVKRRQTTGSSGDETEQDTIREHRRQPSASPTGLDSSGYSSAGGAASEDWSVISDAEGDTRRSSISRDASGRSSKRNSAFTSAVLSVIPDSFKPSSPRKRAASIGSRT

SEQ ID NO: 7872 - protein, 1327 aa, Talaromyces marneffei
MASHDDSEKKRVSHRIRSLSKSLHRLSSNNVPDRLKNNDDEQEDFTAPPKNLAGRDISYMHQSVFSLIAAAGSRSDFHSRFDESSDSDGEDSEGKKRPDPLHRRLVGRLSNRTGKELSSSQVIPEEAGQEARPSRKPSTSSVNSHRRTGSGNRLLRSIPSIVPKRNDKEGKPDQVTQAAQSPQDESQPAQETSKTTPRTAPILSRMIEAQTRFDPAALSTEEHAQAEKEADDKQSDEQKSKLLLPIRLKEIFGFENPEPVIGEYPCWLMQNVALQGYMYITEGHICFYAYLPQKSNVAVKSGQLSKRGRKNPRYKRYWFSLKGDVFSYYEDPSKLYFPSGHIDLRYGISASLADKEKGKDTRDFTVTTDQRSYFFRADSASSANEWVKALQKVIFRSQNEGGRVKISLPLEDVIDIEESPMMDLAQTFKIRVVDIYETYAIDEHFFSFFNFGQDAFEVLKGLINDSTARRIAQDPAATQVLNEVVSESYRQRADSSASEKPDANLESSSAQKSETSDQNHESDSFVQSIGQTESSLSLQSHPDTIVTASQILTRDDVFNSPTIHSLRPNTSLEASAPTIHELVKAGTYPLQRAAGFAEYLKSRSRQMSSLLATESMGYIEKVSGMWIGGGKHYAEGEDPALEQYFDGEDAETSGTYGDRFRAHFALPPTEKLQATYYGYLHRVLPLYGKIYIGNSKFCFRSLLPGTRTKMILPIKDIENVEKEKGFRFGYQGLVLIIRGHEELFFEFNTADSRDDCAVTLHHRLESVRFLAQSSILAQKDKDEADAAKAEQQLLQEATQAPPIEDSQEVHPIFDDPRASIVNFKPTESLRITCLTIGSRGDVQPYIGLCKGLLAEGHRPKIATHAEFEPWVRQHGIDFAPVEGDPAELMRICVENGMFTYSFLKEASSKFRGWIDDLLTSAWNACQDSDVLIESPSAMAGIHIAEALRIPYFRGFTMPWSRTRAYPHAFAVPEHKMGGAYNYITYVMFDNVFWRAISGQVNRWRKMELGLRGTTLDKMQANKVPFLYNYSPSVVPPPLDYPDWIRVTGYWFLNEASSWTPPTELVNFIKKTREDGKKIVYIGFGSIVVSDPAALTRTIVESVQKADVRCILSKGWSDRLGDPKSTRSEVPLPAEIHQIQSAPHDWLFTQIDAAVHHGGAGTTGASLRAGVPTIIKPFFGDQFFFGSRIEDLGVGICMKKLNVGVFSRALWEATHSERMILKAKLLGEQIRKEDGVGNAIQAIYRDLEYATTLTCQRASLSATPLSPASATGENPATEEGEEPEDMEGEESWTFVDDYADPELLKNENLFYQKNFTYSPASSPTLANR

SEQ ID NO: 7873 - protein, 1386 aa, Erysiphe necator
MAVEGVEGLTMSKNYENKKFRIPEKASIPERFQDEDDVEEDCTAPSGTNTYMSQSVFGMLATVGPQIDYTARFHIQSSDDEESEASPQNAEARETRIPDGSHFNKPVKLRKKFSRHKLLCSVSELGSKSTSTPSSSDLNKRSSVRPKKIAPSSSSYLPVRPAMVMSRMLEAQEAMNLRPDSNAPIMDMNVKEKEEHIRNCLSRKLKEIFSLETAEEVIEEYPCCLMNSVLLQGYMYITKKHICFYAYLPKKSNEVVKSGYLYKSGRRNLKFHRYWFRLKGDVLSYYNDPSDLYFLRGNIDLRYGISATVASKENSKDAVYFNVVTHQREFNFKADSVASAKEWVKVLQKIIFQSHNEGDSVKISLPINNVIDIEEIQIIDFADTCKIRAVDNGDTYAVDEYFFSFFSFGKEALSLLRRVVEDTTAQHIPDEVLGISPNKKSDPGDEISSSKWNCGLSPKGKKPVSNSLPQIPNVPLLEENVRATLTLIENTTPRVSSEINQVSYDGGRRSLDQKSTARSGISPFRLERDVTKNKPKSPNEKIAKLNGEPLNNDNLSRTSCNTSATEGQILKSSETLFPPEIEQESQTISIIENKTDPLSNKTPVISYTRPSNDLAMEPLLDENECSVTTPTLQSIVKASAYPLQKAAGFAGYINKHSRRMSSLLATESIVYAEKVSGMWKGGKKHYGESHGLESEYLYEEGDNEDIISSIERFREHFSLPETEKLHATYFGFLNRVLPLYGKIYISDQSFCFRSLLPGTSTKLILPLIDIENADKENGFRFGYSGLVVVIRGHEELFFEFPQSETRDDCAVTLLQKLDTLRFLRESGQLAIKEEENAQNAVNEHLALQQVRSKRFDLNLSEKLKEKNIESAPITFDDPRASILNFKPNESLRVTCLTIGSRGDVQPYIALCKGLLAEGHQARIATHIEFKDWVESYGIDFKAVSGDPAELMRICIENGMFTYSFLREASSKFRGWIDELLSSAWVACQDSDLLIESPSAMGGIHIAEALEIPYFRAFTMPWTRTRAYPHAFAVPEHKMGGAYNYITYVMFDNIFWKAIAGQVNMWRKKQLGLYSTNLEKMQANKVPFLYNFSPAVVAPPLDYSDWIRVTGYWFLDEGTDWEPSKELTDFIDKAKKDEKKIVYIGFGSIIVQDSVALMTTIIKSVEKADIRCILSRGWSDRLDKKNAKKTEPPLPSSIIQIRSAPHDWLFSRIDAAAHHGGAGTTGASLRAGLPTIVKPFFGDQYFFGSRVEDLGVGIVVKKLNVSLFSRALWQVCNDERMIIKAKILGETIRKENGVDTAIQAIYRDLDYARSLIKRRSRKLTDDVLDDSEESWTFIGEEKDAELVLRLQNWKAKNVNKGNSPFNEREDDSDEGALQKNLIVENSV

SEQ ID NO: 7874 - protein, 1455 aa, Trametes versicolor
MAHNTPPGSPPTIPGSLPSTSASPASEPDSAQTPTLPSIGGLAQRTLDKTRDTPLLSQSQPALPQPGPMRMFSLTRKGKEKHTHDGDHATTSQSQVLASRPKSPSRLSSRRRKPATGGEEESPFITPSSPSLGPSQPENAIWRGFRSMHAGTQTFIQALQAVPWAEDQDNDDEFLNHNATPAEAESDEDDRPVNRLTSSIHAIYRPLARFRRGEPSSSTHPSARGHTLPTLSDTEDSAPSGDHPMSDEEGDFEPTAPDHVMGLSHTGRTSPEPILGLDASIMEIQELGSRERAAGRSANMATVRQNRRTQLAEKLRDVFELDNINEVVAEMPCWLLRSVLLQGYMYLTDAYICFFAHLPSREDQVLKSGSLLKRAQRTKRWIRHWFILKNDVLSWYQSASDPYFPHGVVDLRYAISCEAVNEKDIRLRTNEKSIRLSADSAASRDEWVKAILKVILKITNMGDSIKIAIPYPAVVDVDRSNTMEFSETIEIKVQDKSSDLALDSYFFAYFNNLPGALEQIRDAVRAYRTMPSFQHAPVVVDTTTARSPGPRPTVEHVPSTPDAGQHPKSPSGFKLTSLLRPLQETLPMGRSASTPGPSTGDTNNEDFTHIIKRSGSSFVPIATAAETTSPIEGEPSGRPDLLRASSSSLTPVPTPTPADHTYPPSMSGSSSDVHPHPHSAGSSTKDAPSGSGWSVGMPSMPSWLRVPSRSLLFGVPTLSGVRPHLEHAMTLPATHALPGVTEIVSSHSRGSSRSRFHTTSASASGDFGFFSILETPHDGVDAETVDKFRQAFAFDDKENLLGIFPGYLYRLLPVHGRLYVSSNYFCFKSTGPLTSRTRMMLPLKDILSTEKQKSFHFGHYGLVVIVRGHEELFFEFADEERRDAFVNVLQRQLDDTRQRIASGDTRSTSSGRQDALILEEFGSRDPLERSDSQGSLSESAAPAHMFTSQSSTFLSFKPDKSLHFTMLTIGSRGDVQPYIALAKGLMADGHRVRIATHGEFKEWVESHGIEFGYVGGDPAELMRICVENGTFTVAFLKEGVAKFRGWIDDLLKTSWEACQGTDVLIESPSAMGGYHIAEALKIPYFRAFTMTWTRTRAYPHAFAVPEHKMGGNYNYMTYVLFDQVFWRGTAGQINRWRRNTLGLPGTSLDKMDPHKIPFLYNFSPIIVPQPLDWPEWIRVTGYWFLDDADVGSKKWEPPQSLLDFMAEARKAKKKIVYIGFGSIVVPDPKTMTRCVIDAIVESGVYAIMSKGWSDRLVKNAPAQTEPEEPLPKQIYPISSIPHDWLFKQIDAACHHGGAGTTGASLRAGIPTIIKPFFGDQFFWADRVEALGVGAAVRKLTVDVLAQALRDATTNQKQIDRAKAVGEQIRAENGVAVAMEAIYRDLEYARSLIKGASHHDRDLREELFDAEHATIRDYPSGSPDEHPSPSGSATGPASDWSVISDSDEPSHDSHEL

SEQ ID NO: 7875 - protein, 1456 aa, Leptosphaeria maculans
MASQDRGSDRTSRRLTKKRKDGKKPMRDVSLDMPERFKDGDDAHEDVTAPKGNHTMSMNQSIFSMIARAGQQSNTDLGTMQEVDSGDSDDEGTRNVPYHILDGAARLSRLSTANDFQKTSGQTRDGKTEKGKHGRALSENKLLRSLPKLKIASRKDARSDGQGADQMSSSQFLPPRPSPEGSMPAPASSPPPPAAKGRVRPGDGIQMEKGRNVARKTRQRSPAAAATGEAPVSLAKRIQHIFEFAQEEEVISEYPCWLLQSILLQGYMYITQKHICFYAYIPKKHHDVSKTGYLSKRGRSKHNRYWFILRGDVLAYYTNPAELYFPRNRINLQYAISAEVLEPKRKGDEETSFVVTTDERTYQFKADSVASAREWVKSIQKVIFRTHNEGNSVKISLPIQNVLEIEESSILDFAETAKVRVIDNDETFAIDEYFFSFFTKGQDALNVLRIMINDNEHHQAAQKPVEPPSRALGQSDSGFMASTNAPSEVPHITENVRATLSPLTAPHVGRSSMSDISVRSSVDANRKNRDVRRSMDAGRTLRRWSLEGRRLSHEAHRSPSPSGHDKTHKGRVGDRSPKSPRATDSDSATFSLDPGTESSAAIQSMDDSTASASQILDRSDLFRAPVVSSPNAFSNGVNMSAHSQDTTRSSAPRPAYSKGTHPTTSPSIDPLSPGAPDGEYDTDAGGATRLSGSSSALQDIASYPLQKASGLAGFLRTRSKKMGNLLAAESMGYYEKVSGMLAGGRKHYNTAEGLETDDQVNVYEDDEDAAKATDNFREHFAFREDEVLQSSFFASLQRVLPNYGKIYISGRYFCFRSLMPTSKTKIILPMKDIENVNKEKGFRLGYYGLAIVIRGHEELFFEFGKAEYRDECAITVLRILENTKYLEDDQSSSSGVDSNDEAAKAEHDLLQQAREDNNVDKTKNLSEIVRAAADDRIPLIFDDPLASFVDFKPPEPLTIVCLTIGSRGDVQPYIALCKELLKEGHKPRIATHAEFEPWVRKHGIDFAPVDGNPAELMRICVEHGMFTYNFMKEANSKFRGWLDDVCSSSWRACQGADVLIESPSTMAGIHIAEALEIPYFRAFTMPWTRTRAYPHAFSVLEKKMGGGYNSITYITFDTIFWTAISGQINKWRRRELGLQNTSQSKMQASLRPFLYNFSPHVVPPPLDWPDWVRVTGYWFLDEADTYEPPADLVAFMDKARKDGKKLVYVGFGSIVIDDPAALTKTVVDSVLKADVRCVLSKGWSDRLETKDASKPEIPLPSEIFQIQSAPHDWLFKQMDAAVHHGGSGTTGASLRAGIPTIIKPFFGDQYFFAQRVEDMGVGVWLKKVNTSVFSRALWEVTNSQRMIVKARVLGQKIRKDNGTQVAIQTIYRELDRARSLVKKHAKLDGELSEEFEEDWTMVEDGEEIDVPHPFEVQQPVAGISQDASKMGGGSLVLGSMVLKGAQKRSPESAYRG

SEQ ID NO: 7876 - protein, 1519 aa, Sporisorium scitamineum
MGLRPLFGSRASVNDVRDSFGATVELVKSSESEHADPFDQPQHSHDAQPDSSQQPVSEQSPQQQAHQHQDRNGLAGLLNGAALMSNKDAQSKPRDRHDQDNLVPAESHQPAQPVSLDSSEDTAAWNKSRNEAETSDQHESARNRSKFGRTLKMVDAKIRSKIGVNPPPTAQELKSPYSIGNDDHLTSHNHQGAAELLNDAQLETLQHLSEDDDQDDQDEDDNDDDDDEEEDGDDHDQGLHDNAKKPNAAIIQEHVQELERTKNVAEHRRSGSMDGARPGDNIRTHAPTPISAEEKMKAIIEEFGECASVSAPNEPERLLIDHSGVLMKTVLIKGSLFLTNRRVCFLAYIPDAARNNDNGSEHHQVGLASSKNPSDVCAPSDPNVQNPILKSGPAVLHRPGKMRPKRRVWMELRKDSFNAYSASNKLYKPLLSTRLSNLYAVLPIDWAQPNIIRFVEGLKYSSVEFKTQEAALDWRKELEAAAFHARNTADKVRISIPLERIVGLDSASFMQVAKVIHIDVLIGAVNEAEAAHIAQEHRERVDRHQLDHSWSSGDVFLNCPKDPGFKCHTTQVAFGVTHNRTAFIDLLREALKEPASIHKSAGFHDTLRTVPAPLLDLESDADAEDTSTDGNASSDDQKSSLADKFCQAFGLPDRPEELHIVKAELVRTLHTHGTMAIGLDYLLFWRRAVGRDLKVKVPLNDLQGVDTYRSMLWHHFGLVVHITAHSDMYFDFTSKDNRDLVLSTLKNYIEAKQTQKNDAERASLNTEDSQATKVEGAAGAGTAQVLLHDSTAEVPVFEPEMLSYLPKVVNMDRTVMRDAIRISPMRIYCLTIGSRGDVQPYIALCKALKLHGHTPVIVSHPEYRGWVEGHGIEYRGVGGDPAALMKLSVEHRIFSPAFFKESIGKFRVWLDELLRECWEECQGADLLIESPSTMAGIHVAEGLGIPYFRAFTMPWTKTSAYPQAFSVPSIEMGPSYNSSSYTLFDQIMWVATSGQINRWRKHMVGIGPTDMSKMDADSVPFIYNFSPAVVPMPNDWGDRVKISGYWFLDNPESNWSPPKELSDFLARTKKDGKKIAYIGFGSITIENAEEVSANIMKAVHAADVRAIVAKGWSGRGGSKPKKKKKQAKHDCKPTLQHENCAASHTEGEETATEEEHEPEIEIPDDVFVVDSIPHDWLFPQIDIAMHHGGAGTTGASLRAGLVTLIKPFFGDQFFWANRVQKLGAGARVNGLSVSDLTDALKSAVQDRVMVEKAQGVGEKIRSEDGAATAIEFLYKNIPLANRRTQRRLEREASHPTSPSETRINPLSRFSSHGRQRSHDGQEAPHAHRASTLPSVSSSRPLSPSQDAPHRSTSTIVESPADEVESPTRTDSFASKLFSPLPSMPSMPSMPSFNVLPSSMSQLFKEMVTLNHDTNDTTADGEEAPNSLSKRSRTAPSGAITGDETEEHKMARLKGYKNAKAEDIRRRKLLLEKLEREKREREKEEKKEKKGEKEEKEEKKGEKAEKGETGEKADAASVQA

SEQ ID NO: 7877 - protein, 430 aa, Ideonella sakaiensis
MRVLLLTLGSRGDIEPFIALGIGLRAAGHEVTLGATRHLADVIEGHGLRHAPMDDGFFELLHSRAGREGVQRSGSITGMLSTTLRLARQLGPMQLQIQRDCWAAAQASRPHLIVHHLKLMGAPDLAHALGIPAVLALLVPMVQPTAAWPCPVLPRGPDRLAGAVGRRAGYHVVNALANRFGLGPVRRWRREQGLAPRPPAIDLRHDAARRPVGLLHAHSESLLPRPADWPPHAVATGFWRLPARADSPLPPTLLAFIEAGPPPVYVGFGSMAGRDPSGLARTVIDALAQAGLRGVLARGWGGLETTAVPAHVHLIDEAPHDRLLPLMAAAVHHGGAGTTAAALLAGRPSVVCPFFGDQSFWGRQLHEAGLAPAPIPQQRLTAARLAAALQEAVRSEPLRRAATVMAGRLRAEDGVGRAVDWLQRWQAGQR

SEQ ID NO: 7878 - protein, 1445 aa, Pisolithus tinctorius
MSRLVPRKSRTSPVSTDDARDPSSQGESGEQGREDHVSPQECIKRVAARTIDLRKSITGRMQSSPTSPESRRVFSSNRKGKGKDTPGRDQAEGTLHADSTQSQTLPERASALNSMDDSPFIRPPSPPPTLPDRPSLQAIQGVGSMRAGTQTLIQALQALPWVDDPDNDDDPGSSTAPNIDSDDGSKGHVASSIHAIYRPVAWSRHIGSSLPDLSAKQRSVLADVSGETDSDPELSMAFEDDVDADDFEATTPRPDDIRKPEASPLVMAAELSTSLKRRAASRTGSMATVKVSRRARLAEKLREIFDIDVLHEVWAEMPCWLLRSVLLQGYMYLTNSHICFFAHMPSREDQILKSGSLSKKATRTKRWIKYWFVLKNDALSWYQSSSDPYFLNGIVDLRYVMACEPVGEKEIRLRTNQKNVLLSADSVPSRDEWVKAIRKVMFKAQNMGDTVKIAIPYSVILDVEKSTAMDFSETIEVKVMDKVDSPDSYFFAYFHDIQAALDHIRDAVRTHRALAPTSPQAVLDTTVKPSTGVAPGIDRARSLPTSDAKGAIPSRLSLLFRPFQDSLPLPIARMSSSPEPPNGAEEYTHISKRGTFVPITASPQSYSANELASPTTYNSTPAIPSSTPALVRDHTYPPTTPSIESNTSSPIRILPSGVPWNMSVPSWLRSARKAAGSSVSTTGIGPTPTSSQSLGSVREVYSAPRRSSSDQPLGTAAELGYSVLETAEAVVDPETTEKFRAAFAFDDREVLLGHFSGYLFRVLPLYGRLYVSSNYFCFKSSGPLTPKTKARSMCTMILPIRDILNVEKSRATRFGHYGLTVVIKGHEELFFEFGVEDRRTAFVSILERQMEDLRKRPSGGEIPKLSQGQRDALILEEFEPRNSASSDTDPAPPSEALSESLPAVMFTSASSTFLTFKPKESLHFTFLTVGTRGDVQPYIALAKGLIADGHRCRIATHGEFQAWIESHGIEFGYVGGDPAELMRICVENGTFTVSFLKEGLLKFRGWLDDLLKTSWEACQGTDVLVESPSAMGGYHIAEALRIPYFRAFTMTWTRTRAYPHAFAVPDHKMGGGYNYMSYVMFDQVFWRAISGQINRWRRNLLHLENTSLDRMEPHKIPFLYNFSPTIVPQPLDWPEWIHRAGYWFLDDAEVGAKKWTPPQDLISFIDDAHQAGKKVVYIGFGSIVVSDPRGMTRCIIEAIVESGVYAILSKGWSDRLHTKTSEACEPEEPLPKQIYAISSIPHDWLFRRIDAACHHGGAGTTGASLRAGIPTIIKPFFGDQFFWADRVEALGIGASVRKLTVENLKDALVVATTDQKQIDRAKLVGEQIRSENGVATAIEAIYRDLDYARSLIKRPTNAVEEAEESPTPEGAGSRSRYDSGGSQRGSEDWSMVSDPDESRSSFGSRRSDPTSLKRHSLAAAVMSVLPGALASSDHRRSNSTSSRHP

SEQ ID NO: 7879 - protein, 293 aa, Elsinoe australis
MRYGHRVRIATHNVFADFVQDSGLEFYPIGGNPAELMAYMVRNPGIIPQMDTLRSGEIKKKRLMIEQMSEGCWSSCIEPNPSTGNPFVADAIIANPPSFACVHCAQALGIPVHLMFTMPWSNTRHFPHPLANLKNAADERSRKNYASLSDVVNRWRKTLHLEDTPTFNGPALAEKWNIPFTYCWSPALVPKPTDWPSHITSNKLDVCGFFFRESPKHDPPEQICRFLEKGPPPVYIGFGSIVLDNPQRITAAILEAVNTLGIRAIISRGWSDLGGNEDTGGDRNVLFIGDYKV

SEQ ID NO: 7880 - protein, 912 aa, Byssochlamys spectabilis
MTSDTGDDQKWLQKQSINDNRNVMTIARSLHEVFSKFTIALESAGQPHEYTIKNDKPNLADIWLIEWTGYRIKFVNHNTPYDLPDPILLETHAIIARILHATGMAEQIDRLQYKKSDSHALAGDGTDGRIDLDLDSPACRAIGALVRPSSEVQGDTEAPPSYSEAVQAAVKLNIVIQIVGSRGDVQPFIALGQELRRYGHRVRLATHGVFESWIKQTGLEFFSIGGNPKELMAYMVKNPGLIPQMKNINVKDIQKKRQMIAEMLDGCWMSCIEDDPTTKVPFVADAIIANPPSFAHIHCAQALGIPVHLMFTMPWTNTREVPHPLANVKSSKTTPTVANYLSYSIVEWLTWQGLSDIVDDFRARLDLEPVPTNEGPSLLDTLKIPFTYCWSPALMRKPQDWPHHIDVCGFFFREVPDFQPPPDLVDFIQRGPKPIYIGFGSIVVKDPQKFTATVLQAIRQAGVRAVVSRGWNSLDGDSSADIFYLDECPHEWLFQHVAAVVHHGGAGTTACGLRYGRPTAIVPFFGDQPFWGRLVATAGAGPAPIPYRSLNSHNLSEAIRLCLRPEITRAAEAISDKMGQESGVQAAVHSFYRHLPWENMRCNLLPDRPACWVYKKSKTKRTMLLSKAAAQILLSHSRISAKDLRPYETKRIEIKLRRYDPLSSTTSAFVETGTKMVKATGDIFLKPYQEYERGRKETKAPSIASTSDSAFVPESDCTDTSSTSRGSDRRRESLKTGMLMVSGSAKSAGRVIGSFSKGAIVDIPLATTEGLRAVPRLYGEEVEDYGTVTDWKSGGIVAGKTFVGGMKDRLADLFVQPYKGGKEEGALGVAKGVMKGTLGVASKCSSAALGLVAYSGQGILKSVHDLGRTKTKRMIAAARVKEGEYLEDLASEIGITPSAVIRAFEAHERGED

SEQ ID NO: 7881 - protein, 471 aa, Lysobacter capsici
MSAPTLALPAAGPAANDHSVDGPVQPGAIVIFTVGTQGDARPCIGLGQALHRAGYPVRIVTSDNFAPLVREAGLEFCAISADFSDLLTNNPETVDKALNPWFLVKHTRAKFAEWAATWAKEARPACQGAALLIGTGIVTQLAKALGEAENVPFLQAHLQPFTPSRKLSPLSFWSKREFPGWANMALFSVMKLLAWYTLKPAVNGAIRPQLKLPLYPWYGPYFDKDPGRMRVLYGYSRHILPRPDDWPEQVRVTGSWFLDQAGEWQPPQSLTDFLAEGEKPIYIGFGSMLANNAEAFTDIVVDAVRLSGRRAVLATGWGGLRREPGRMDDQIYVIEAAPHDWLFPRMAMAMHHGGAGTTVAAARAGIPSVFVPFFGDQPFWARRMNELGVAPPALDRRTVDAAQMAQAIAQALEPQRIDAAHVLGEKIRAENGNATAVRTLGEWGLLPPLRGGHEAATPATAPTSEPLVQVA

SEQ ID NO: 7882 - protein, 1436 aa, Pseudogymnoascus sp.
MIRSHEDIKKRVGRKLTKKRREDRRVTMEIPKRFEDGDDADEDCTAPKGQNGLINQSVFGMIAAAGSQADFHARFDGQDSDDEEDETTESEDAGRPSEAASDPATSKASADEHKSRHRTHRHKLSDSKILRSFSQLGIKNKSKHAQLSSSSSDPVTPEKIKDTERYHAARSPFKGPPIMSQMLEAKAAAVQRASFDSRRSDYISGQTDGADGGEGAPSDLAIRLMEIFEFESPEMVIDEYPCWLMKSVLLQGYMYLTEKHICFYAYLPKKSNEIVKSGYLSKRGLKNPKYNRYWFCLQGDVLSYYTDPSDKYFPSGNIDLRYGISASVVDKDKTLFEVITNHRRYQFHADSIPSAKEWVKALQKIIFRSHNDGDSVKISLPIENVIDVEDSPVIEFAETCKIRVIDNDETYAIDEYFFSFFSFGKQALSVLRTLVSDSAAKQIPEELLVQPQGNSSGNSPKGGSSRPSLTLSTKGSKSNLNPAKATGSGLEDSVKATLAPLMSSPLHVHSPRASGEFSRSSFDVNHRSNSQTRNSRRSMDGSRFKLDGQGRDGSPSNARRSFSRNRPSEKKNSEKQDSSDSYVHSMEESSGAAQSASEDVEGSASQILRGSEGFFQPTIHRSGSASRRRDDSQLPGGPLLPETPTTVPHAVTIDAYERPKLAHAEGGSSPSLQTLAKAGAYPLQRAAGFANYLNRHSKRMSTLLATESMGYVEKVSGMWKGGKKHYDEPLGQGLEDDTDDELSGHSDGAEGRFQAHFALPAGEKLHAAYFGYFHRVLPLYGKIYISNRSFCFRSLLPGSRTKLILPLKDIENVDKEKGFRFGYSGLVVVVKGHEELFFEFGQPDARDDCCVTLLQNLETIRYLKESGLLTQEEEESAAWAVAEHKALQEARQESRQHGHDLELPNTAEGASTDSAPIMFDDPRASILNFKPTESLRITCLTIGSRGDVQPYIALCKGFIAEGHKPKIATHVEFKDWIEGHGIEFAPVGGDPAELMRICVENGMFTYSFLKEASTNFRGWIDDLLSSSWLACQNSDVLIESPSAMAGIHIAEALGIPYFRAFTMPWTRTRAYPHAFAVPEHKMGGAYNYITYVMFENVFWKAIAGQINRWRKKELSLPRTSLEKMQPNKVPFLYNFSPSVVVPPLDYSDWIRVTGYWFLDEGTGYTPPKEISDFIAKARADGKKLVYIGFGSIVVSDSAALTKTVVNSVLKADVRCILSKGWSDRLDKIGATEPEVLPEEILQIKSAPHDWLFTQVDAVAHHGGSGTTGASLRAGKPTIIKPFFGDQFFYGSRVEDLGVGIYLRKLNVSVFARALWEATHSERIIAKATLLGEQIRSENGVDTAIQCIYRDMEYANSLIKRKSAVTHEGLGEEIEESWTFIGDDNDPELMSRIHAWDPRVVLAHSRDLTEPQLKDVAESPVPTSRSETPLPSEQEAG

SEQ ID NO: 7883 - protein, 802 aa, Fusarium fujikuroi
MSPTPDDNQSHRQTRYFELPANGEHSAQLPDELPPYQALAELEATTTGREDGRIDIDLSSRIARRLSKLVPTGKPPISYGQNQPPAYTETSEKSIRLNIVIQVVGSRGDVQPFVALGTELQRHGHRVRLATHGQFDKFVRESGLEFFSIGGDPAELMAYMVKNPGLFPSMKTLRGGEIQRKRKMVDEMLHKCWSSCIEPDELTGRPFVADAIIANPPSFAHIHCAQALGIPLHLMFTMPWTSTREFCHPLANLKANGSDMSATAANYVSYSLVEWMTWQGLGDIINAWRDTIDLEAIPFSEGPCLTETLGVPVTYCWSPALVPKPADWPENIDVCGFFFRDAPKYQPEPALQQFLASGPPPIYIGFGSIVIDDPDKLTATILDAVRATGTRAIVSRGWSKLGGDSPGDDQVFFLGDCPHEWLFQHVTAVIHHGGAGTTACGLLNAKPTTIVPFFGDQPFWGNMVHAGGAGPAPIPFKALNSSNLAEAILFCLTPEASAAARQIADKMSSAELLVEDEKVSWNNLKAYQPQPVHIENRRWDPVTATLATLATTSVGMVTSASDIVVKPIQALRPVTPSGSRSASRDRSRNNSKRPSEEDVFGRPAGIDLSSAPTATKDKDPNHGALAAVKGSASGVGGFFKHYSKGMLLDLPYAVTEGMRNAPKLYGGKAYDPGAVTDWKSGGIAAGKNFAHGMVEGIGGIVMEPVRGAKKEGAAGAAKGVGIGLLNLGTKVGSGALGLFALPSQGAYMSARALVKRKTGKSIMEARKIEGRDAVERSGEEIRQKDRTTVMEGFETLTREMKK

SEQ ID NO: 7884 - protein, 419 aa, Unknown
  Description of Unknown: Rhodobacterales bacterium HTCC2654 sequence
MRILILTYGSRGDVQPFVALGRALVARGHEVTLGTARRFETFVREAGLGFAPMSDAMLNLLDTEAGRDMMESTQGVLQSLKWTVMLTRTVGPAQAELIGDSWAAAEAVDPDLIVFHPKTYAGPHIAEKRGIPAVLAMLVPMMVPTGERPNVGFPDTGWQWWNRFSYRFVNRTMAFSAGRHVREMRAERGLPKQRRFDLLRDSRGRMLPVLNAVSPSVLPAPRDWPDEAVMTGYWFTDHGDWTPPDELAAFLEAGPPPVYVGFGSMAGRSPGRLAKAVIEALTRTGMRGIIATGWGGLKPADLPDTIHKIEGAPHDWLFPRMAAIVHHGGAGTTAAAIRAGKPQVVVPFFGDQPFWGKIMAQHGVAPDPIAQKSLTADNLAEALRRVTGDPAMAQAAEALGAAVRQEDGLKRAVEVIEAA

SEQ ID NO: 7885 - protein, 1240 aa, Zygosaccharomyces rouxii
MDIKGKVPFLRKVEGSFRKKDSSNKKGEKPSHSNKASSSISSAETSPSKRADDSVTTPEGQVGNQDDSGDAGGLDTAKARYTPKSIVELLTTASVVAGMGEQQQAKDVADELDGGDIDSDEFVDAKSEVSVEPASGGKVEDVDVSRVDDGKYSNEQAGFDGTTTARSLGFDLSVEPVEKTRDYINSLDLTRRRTMIQKLVDHFKLSEDEKFVGDFPAFLLKDVLIQGQIYLTSMHLLFFAYLPTNSDEVQLSGNLNVHSRIRGSTRYWAVLRNQSLSLYSSPTETYFPELEIDLKTTASITAIQSKTTGKPTNSFKIETKKRNFTFSADSEFAAKSWTNSLRKQHFAAQNANQNSVSLKIPLVNTMEVIDEPVLEYASTVRVKAVESSVSGVHVEFVFVFLDNSSTTLKRHIDAQLELLEQSGIPALGRVFSSGQNVVSDSTDASIRGKNPNDSNEGADVSSPKRASHLHHILPHFPRRQGSSSSEEKSSGLSSLKPKFGSNSRGNGDTDASSSSSHLLIPVKSVVQKPKSFVQDFNTKAHVTTGNGSWSSSSDVDENATESKKGHQHRYFRHGLWNNKPIHYRNTSVPFGDEDPYLASPDENKAANEKFREHFHLDSNANLIGAYFAHLSRNIPVYGKVYLSEDMMGFRSLLPGTHTKMNLPLVDVEACYKEQAFSFGYEDLILVVRGNNELCFAFSSTEARDDAESIIRKRMEVLKLRRREIMNPTTNILEVDPHFAKMKLVEDKINAGGIDAPLVVDKNPYYATTIKPHGKKLKIGLLTIGSRGDVQPYIAFGKGLQKEGHDVVIITHGEFREFVESRGIAFDEVAGNPAELMSLMVEHESLNVGLLKNAATNFRSWIAELLQTAWKACVRSEIDVLVESPSAMAGIHIAEALQIPYLRAFTMPWTRTRAYPHAFIVPDQPKGGNYNYMTHVLWENIFWKGISGQVNKWRVETLDLPKTNLELMQQSKVPFLYNVSPSIFPPAVDFCEWVKVTGYWFLDEGQSYTPPPDLETFIAKARKLNKKLVYIGFGSIVVSDAKEMTKAITEAVLEADVYCILNKGWSDRLSSKSDKKEIEEPLPESIYNSGSIPHDWLFPQMDAAVHHGGSGTTGASLKAGCPTIVKPFFGDQYFYATRVQDIGAGIALKKLTGKSLARALKEATHNEKMKMKAQEIKEKISLEDGVKTAINCLYTELEYAKSLVVVKAEQRNSPRSRLLELPSFAAPKLPDLNLEKTFAFL

SEQ ID NO: 7886 - protein, 1295 aa, Dichomitus squalens
MHAGTQTFIQALQAVPWAEDQDNDDEEMNHDATPVGTESDDEDRSVNRLTSSIHAIYRPLARSRKGEAPSSHRAARSPDLPSVSDNEEASRPDDVSPSDDDTEGDFESHEGGLITGPGHSGRMSPETIPDLDSSVLEAHGSTRGTGRSGSMATVRQNRRAQLAGKLRDVFELSNINEVVAEMPCWLLRSVLLQGYMYLTDAYICFFAHLPSREDQVLKSGFLFKKAQRTKRWIRHWFVLKNDVLSWYQSASDPYFPHGVVDLRYAISCEPVNQKDIRLRTNQKSIRLSADSVPSRDEWVKAIRKVMLKAQNNGDTKIAIPYPTVVDVDVSGAMDFSETIEIKVQDKTTDLALDSYFFAYFQDLPTALEQIRDAVRTYRGIPSIDCSPTVVDSTSARSPSAQSPTKPSAGPHTKHPAGFRLTSLLWPLQETHGRSGSTHGANNAHNEDFTHIVKKSSSSFVPIATTNETTSPTEGGPGSLRNSTATLTPTSTLTASDHTYPPSTSASVVDFRGNGAAGSTKEPTASSSGSGWSVGIPSIPSIPAWLRAPSRSLFGVPSTSNLARPVIEHAATVHLPPSAHALRTVSEVVSSRASSAGKLPSASMSGDFGFFSILETPETAVDSEMVDKFRDAFAFDDKENLLGMFTGYLFRLLPVYGRLYVSDNYFCFKSSGPLTSKTKMILPLRDVLATEKSKSFRFGHHGLVVIVKGHEELFFEFVDEERRNALISVLQKQIEVVRQRTSSGDPRAPSDGHHEALILEEYGARNALDMDESRSTSSESAPAYMFTSQSSTFLSFKPEKSLHFTFLTIGSRGDVQPYIALAKGLKADGHRVRIATHGEFKEWIESHGIEFGYVGGDPAELMRICVENGTFTVAFLKEGVQKASSFRGWIDDLLKTSWEACQGTDVLIESPSAMAGYHIAEALKIPYFRAFTMTWSRTRAYPHAFAVPEHKMGGNYNYMTYVLFDQVFWRGTAGQINRWRKHTLGLPGTSLDKMEPHRIPFLYNFSPTIVPPPLDWPEWIRITGYWFLDAADVGSKKWEPPQDLLDFIDAARKANKKIVYIGFGSIVVPDPKAMTRCVIDAIVQSGVHAILSKGWSDRLVKNVPAQTEPEEPLPKQIYPISSIPHDWLFKQIDAACHHGGAGTTGASLRAGIPTIIKPFFGDQFFWGDRVEALGIGAAVRKLTVESLSQALREATTNQKVIDRAKLVGEQIRAENGVATAIEAIYRDMEYARTLIKGVAQRHIEEHLNAEHATIRDYSGSSTPPERASPSMSASGAVSDWSVISDSDDGPHEPQSP

SEQ ID NO: 7887 - protein, 416 aa, Rhodopseudomonas palustris
MARIAIQTLGTRGDVQPFVALGLGLQKAGLQVSFATAPQFESLVTEHGLQFHPLPGDLVDLIQTPLGKAAISGRHKLIATLRLMARVRPMFRPLLDAQWAAAQGADAIVYHPKAIGGVHIAEKLGIAAFVALPLPALSPTRAFPSPLLPFADLGPLNRASHALTIRYGDLAFRKAVRTWRREVLGLPAASDWLSLRGRPVTKLYPYSPAVVPVPADWDATSQVTGYWFLDEAEDWTPPAPLAAFLQAGPPPVYVGFGSLPCDDAERVTTLVVDALTRAGQRGVLATGWGGLAIRPMPAHIHMLQEAPHHWLFPRMAAVVHHGGAGTTAAGLRAGRASVICPMFGDQPFWGRAVHALGAGPAPIPHRQLTPERLAAAISSAVHDPAMRRRAMEIGRTISQEDGVAKAVDLIARDSRC

SEQ ID NO: 7888 - protein, 1481 aa, Venturia nashicola
MAPPDAAKLRENLGRRLANRKGPRKVSMDIPERLKEEEDEQDDATATHMNQSIFAMVSAASRASQTDFQSRFDEASSESESENSEQLSRTTPAIGSLPPAPITQEPKPKHKRDSSVGRLFKSMHKGFTPRKSRSSSKDMMSSSQILAPRPPPHIEVDEEESQQDAAQSSGAPMMSRILMGEAEMAMSQHLQPVSEQEDGESASVPKLGSGDLEQRLMDIFNHEEREAIIGEYPCCLLSSVLVQGHLYLTQKHVCFYAYLPKKAAKIALSGHLAKRGLHNPRYNRYYCELKGDVFAYYDNPSTRYFPSGQIDLRAGVSANIADREKNKDGAYFTLVTDKREYMFKADTTTSAREWVKALQKVIFRAHNDGDSVKVSLPIDHIMDIEEVKILDVAQTIKIRVYDNDETYSIDEYFFSFFMLGEEAMRVLKILVEDNALHKCPESDMPTDSDVNEFAAPDSVRPSLNVERTSMASQRTPPLRDTVRATLLPYASVPGQRALSNSRLSTESRRSSMEIRRRSYDSRNSSDGRQSISLSRQFDRSPLSPTSPAPQESLGSPRTTSMDRDTESSAAIQSLDETDASASQILNRSDVFQAPTLHPPQRSGSVDQGQRVSSDTARSTRVSQVPHTSSEQGRNKLQKQRPGPTPINTVQPTLSEQDMTAGSSYSFQNLVRAGTSPLQSAGALGNFLRTRSKRMSNLLASESMGYYEKVSGMWAGGGQHYGQTDGMPDDDDIPGGNENKEERDAMHAQRFREHFALPDSEELKATWYCFLHRVLPLYGKIYLGSTFVCFRPLLPGVRLKLKLPLSDIENVTKEMGYRLGYSGMVVAIRGHEEIFFDFREQSHRDDCNITILKKAEAIKKRRLKESGFLNEEELIAAETARAEHKALQEARKSGQLMGDHEVELPHHLSYIGTDPVLSLLDIADMLSEASETRGIFVDDPRADLAKSPKPMQITCLTIGSRGDVQPYIALAKRLMKDGHKVRIATHDEFKDWVEGHGVDFAPVAGDPAKLMRICVEHGMFTFSFMREATGHFREWLEGLMATAWEGCQGSDLIIESPSAMVGIHIAEALEVPYYRAFTMPWTKTRAYPHAFAVPEIKRGGNYNYLTYVMIENVFWKATANQMNKWRRRSLGLGNTSLGRMQPNKIPFLYNFSPFVVPPPLDFSDWIRITGYWFLDEEDWTPPPQFAKLKAFIKKARDDSKRLVYIGFGSVVVDNPKAMTEAIVEGVEQAGVRCILSKGWSDRLSKEPTDGTIPEVPLPASIMQITYSVPHAWLFAQVDAAVHHGGAGTTGASLRAGIPTIIKPFFGDQFFFGARVEDLGVGICMRKLQGPMLAKTLREATHDQRMIDKASLLGEQIRGEDGVGQAVRAIYRDLDYAKSLIKRKTKDSKTGCVELEEDIEETWTFVGEESDTEERKQTEGGNFTGGDGVMESSLEEMIQESSVLSEERDETVPFEGFDEGDAAAAATSSPIPISAKVKGKMKA

SEQ ID NO: 7889 - protein, 1453 aa, Phialophora attae
MSTQESLPRKSGSRKLQKRRPQMNRLPSSKMPDRLRLGDDAQDDVTAPTRGTQVPGQYMNQSIFSMIAAAGSRTDFNTRFDDSSDSDEDALPEGNEPEEEVPAPKQSSDVAWREEKSTVANSNDKQQKKKKRLSDHRLMQSLPKLSLSINKQRKQSSHRSPPSSDDATSKSDRSNPRDAPVMTRLLTAEAELEEAELDKDKGLGQSRSRGESSPATLLASRLMQIFGFESPEKVVAEYPCWLLQSVLLQGYLYITRQHICFYAYLPKKSNTVAKNGYLAKRGKTNPRYNRYYMILKGDVLSYYSDPSAQYFPQGTIDLRYGISATLSAEKDKQKECKDFSVTTDHRTYNFRADTPESAKEWVKSLQRTIFRSHNDGDSVKISLPIENIIDIEESPVVEFAETVKIRVIENDESYAIDEYFFSFFEHGSDVLNVLSGLGAGSATPGVQDLASPLSDERRARSPGARRSLDMLSHTPRDRSTTPLRDSVRATLKPYALGDDGKMSPRMSGEFSRPSKSPGRQSFDQVTGDYSRASFDRGRRSPSTSGLDVARERRSGKSPLARTQESPESHARSFDKETDSSVPPLSPKAEAHMSASQILTRSDVFHPAKVNRMDTVASMSTEPTGQSSEIETTQSTSSPQQEATPPIPIRTRPSIRQRVLSQDSDFFEAQEQAGKQTGSPTLQDLYKAGSYPLQRAGAFAGYLKNKSNKMTKLLATESMSYFEKVSGMWAGNRKHYGANEDVLSDDRDVDPEDAESNVPHGDRFRMHFALPKTEKLQATYFVWMHRVLPLYGKVYISNRKFCFRSMVPGTRTKLILPLKDVENVDKEKGFRMGYHGLVLVIRGYEELFFEYMSAEDRDDCAITLLQSLEAGKYLDDDSTILPTDEDSAALAKDEHRLLQEARTSTSKRDANVVVPETNETVYSHDQPILFDDPKVSIINFRPPTALRITCLTIGSRGDVQPYIALCKGLLADGHKVRIATHREFQPWIESHGIDFRPVEGDPAELMRICIENGMFTYSFLREASTKFRGWIDELLQSAWEACQESDMLIESPSAMAGIHIAESLRIPYYRAFTMPWTRTRAYPHAFAVPDHKIGGAYNYYSYVMFDNVFWKAIASQVNRWRKKELGLRSTSLDKMQPNKVPFLYNFSPSVVPPPLDYSDWVQVTGYWFLDEATEWTPPADLVAFIEKARADGKKLVYIGFGSIVVSDPAGLTKTVVESVLKADVRCVLAKGWSDRLGDPSALKAEVPLPPEIHQIKAAPHDWLFKQMDAALHHGGAGTTGASLRAGIPTICKPFFGDQFFFGSRVEDLGVGICLKKVNVSLLSRALWEAVNSERMIVKARALGEKIHKENGVQTAIRAIYRDLDYAKSLIKARAELQGQPMPLGDDEEGEIEETWTFIGDESDPELMKKMQDWDISKGGRSGGPRVSMDGLRRCRLLSREGWRRVVCFGSDDPW

SEQ ID NO: 7890 - protein, 1252 aa, Phaeomoniella chlamydospora
MPDDEKNFKQRLTHRFSRHSRPLNRLPSGRLPERLRYGEDANDDVTAPARGAGVPQQYMNQSIFSMIAAAGSKTDFHQRFDESSDSEEEDEQPKDDRPTNRQSLERNTSARAARRPGDPSVAAERYDGKTETAKPGEKKRYSLPKLHPKHGKTRDSRSVYIDSPAREHLSQSKLSRTMTPRDAPMMSRMLEAQAQLSTSGFGSGIIRPPTDEVAARKRSESSPETLLSTRLMEIFGFENPEEVVSEYPCWLLQSVLLQGYLYITEKHLCFYAYLPKKSNVVAKSGYLSKRGRQHLRYHRYWFTLKGDVMSYYNDPSDLYFPSGNIDLRYGISAKPADNKDKTKESKDFSVTTDHRTYHFRADSAASAKEWVKNLQKVIFRSHNEGDSVKISLPIENIIDLEESPVIDFADTFKVRVVEGEESYAIDEFRSRCVQNIAGVDRQERPKVAARLGFVFCSNWQFRPTEASPVGSDRLVPDEDQRPGSSQALQDIIKAGSYPLQRAAGFAEYLKNRSKKMSTLLASESMGYYEKVSGMWAGGHKHYGENEGIMPDDNAVDPEDEEESVGHGDRFRTHFALPPSEKLQATYFGFLHRVLPLYGKIYISNRKFCFRSLLPGTKTKLILPLKDIENVDKEKGFRLGYHGLVLVIRGHEELFFEFNTTDHRDDCAITLLQNLESVKYLSESGLLAEEERAEAEQAKLEHKMLQEARQAGHASHDLKLPQKASDTDSTPSDTAPVLFDDPRASIINFRPTESLRVTCLTIGSRGDVQPYIALCKGLIADGHRARIATHAEFGPWVRKHGIEFKPVEGDPAELMRICVENGMFTYSFLKEASAKFRTWIDDLLSSAWEACKDSDLLIESPSAMAGIHIAEALGIPYFRAFTMPWTRTRAYPHAFAVPEKKIGGAYNYFSYVMFDNVFWKAIAGQVNRWRKRELGLGSTNLDRMQPNKVPFLYNFSPQVVVPPLDYSDWVRVTGYWFLDEGSDYRPPQELMDFINNTRKDGKKLVYIGFGSIVVSDPAALTKTVVDSVLKADVRCILSKGWSDRLGDPAAVKTEVPLPPEIHQIKSAPHDWLFRQIDAAAHHGGAGTTGASLRAGVPTIIKPFFGDQFFFGSRVEDLGVGICMKKVNVSVFSRALWEACHSERMIAKARVLGEEIRKENGVQTAIQAIYRDLEYAKTLVKRRQMVTKSDSPEKPQFDDELQAIEESWTFIGDEADPELAKRIRDFDMKSYAEARSSTISRQRSERKSGRGDHE

SEQ ID NO: 7891 - protein, 1530 aa, Dictyostelium purpureum
MDDFDSKSLNTSQLLRQISYSDNLSSVGSEKRSNHHRLINSQEGEGENHINNSIINDLDNTNSVASIYGSGGSVPNQPHHHLTLSLQQQQEFQQIQQQRQQYSLDSEYTPPNIYILDPDFLERIQNNQKNNIDQLNKTTKTIVELSSGVTKNETTYIETPEENETENRIMRQELLSELSTLDSFTKITKPGELFGFCECTLLYNHLTITNLIITSNYLVFLPQQQVSKDYVLENYLQKKGDFFWRKYWFVLTTDSISWYKNSILKETHYPNGTILLSKIVTVDKLSPDETGKPLCLQIITNTQIHLIQFDTEPQLDHWYDEINRMQKNLKISISFNDIVSIAMESNAALFSDSICLTLKKGENCLVTPVSSSNEFYSLLVKIWNRNRGVHITDSEKQRKMLEFQKTFKLSQGVNIITETPCTFYQDEEFSYDGILYATNDSLYFSSEDSVLIIPDTDILAITIDRKDNRESFKIYTTDYEILHFDNIDNIENFYSAITEPLKNKNSKIFFSSIGQAPPIASINKQKTSGIRSWKIPFGIANIPIPNFSIPIPIPKNIPFMKSKSTNNIDPISNNNQQQQQQTSQLTQSQAIEDNNNNNNNNNNNNIDNKHEKTILIQKNSNINSKFHDIFPLLPLDETVIMHQHCTLYYYSYDSNVEGTVYITKSYIAFNPSPLSKQNLNHSPSSTYDSDSDSDSDSDSDISDDFNTDDNNNNVELDKKLKEREILMRKALIPFEDIVSITKEKFALLFNQCVKIHTNDHKWIFGSLNNLNSFYNLVLDTWKQIPLTENEGIFTPLENVKIKNKLGLPAEENLITWFNCTNFKGAQLKYGFLYISNHHICFRSKFGFQKRTIIIPFSQVIEIKKYSVLIPNGIKITTSAQQDFQFASFIHRNKVYQILHDTWLKSKKSNSNLSSPVLDYQLISPPIQPEQQQQSSQTPKPQPIQLNNEQPSVLNDEKQLPTTLPKINLSLPTSSTPNTPSSSFLSPRSQVSSSSISLTSPTLNSATPNIQSPTLPIRPLKITILTIGSRGDVQPYIALALGLRDYGHYVTLASHELYRDWISKDHGLNYKHLGGDPKELMDLCVRNGIFTPRFIKEALHRFRSFIDDLLLTCWEAAQGSEVLIATPGCFAGPHIAEALQIPFFNSFTMPFTRTRVYPNPFAPFAAHQMGGVFNIATHVMMEKILWQPISGQINQWRTETLKIPAWNSSVSINETIRMPYLYCFSKYLVPKPPDWSGEIDITGYWVLKNSSHDEQAPQDLLDFLKNEEDPPIYIGFGSIVIENPNALSQLLVEAIKLSGKRAIISQGWGGLSLEETPNSIEGSSSSMIYLLKKPIDHSWLFKKVSLVIHHGGAGTTAAGLYASKPTIIIPFFGDQFFWGERIKETGIGTAISFDQLNAKQLSSTIISVLNDSSIVGRVSKISKLLEKEDGIQEAINFIHRHLPFSFIPPRELPFSSAPNACMDCKQPFSLLHVMKIRTHCHNCGKIFCENCANHKIPIKKFRINTPVRVCTACYNQIQSTQNINPFIVNND

SEQ ID NO: 7892 - protein, 1402 aa, Scedosporium apiospermum
MAPFDASSDLEEESKAKHVHVPKKLHKRRPKESITSDDPNMPERLRCLDDAGEEDLTVASQGPTMYMDMNQSIFGLIAAAGSRLDFTDRFHPQSSDDEGDNEGKNDLPPPGSRTTIFRRHAKSPKSSEKSRLKITDHKLLRSLPALPRLSKSKLKKDHSKFPTSPTDTTPSDASDSVSRGSDLESDKRYAPVMSRMLEARAEMAARPSFDLERLSGEGSRDSDSTDLGISPLARKLKEIFEFDEPEEVIEEYPCWLLQCVLLQGFMYITAKHVCFYAYLPKKANEVSKSGYLSKSGKRNPKYNRYWFRLKGDVLSYYADTTNVYFPNGQIDLRYAISANITDKEKEGTHFSVTTHHRTYHLKADSAPSAKEWVKAIQRVIFRSHNDGDSVKISLPIENIIDIEEMHMLEFADTCKIRVLDNDETFVLDEYYFSFFNHGKDAINVLKILVDDAASRQKDMPKISVLAHRPNSPLDPAEVVQATLPRDIVKATLSPHSPPVSPRASADMSRTSFDGFKPFGRSSIDCARNSQDIPRRHFSGTRRSLSRSRDGVDARGGSPWKHGASSESYVHSVDEPSVSALVLSSSDDPSASQILKGSDVFQSPTIRRSTSSTRLKDRHDKLPSGLQPQSPPLKSIAPKHAASTGNLPNPIPHDPNGQSTPPTPTLQQIAKMGSYPLQRAGAFANYLNSTSRKMSSLLASESMGYVEKVSGMWKGGRKHYEQPHALRTDDDEDDDDDSDGNKRATANERFRAHFALPETEKLQSTYFGHLFRVLPLYGKIYISDQNLCFRSLLIGTRTKLILPLKDIENVNKEKGFTFGYSGLVLVIRGHEELFFEFNRSEIRDDCTVTLLRALEKTRFMKDSAQLPIAEDPSAEAARAERDALQEERHEVENSNAINALEAATDGPPILFGDMKTSLLDFKPANPLNITCLTIGSRGDVQPYIALCKGLLAEGHKPRIATHAEFQGWIESHGIEFAKVEGDPGELMRLCIENGTFTWSFLREANSMFRGWLDELLASAWVACQGSDLLIESPSAMAGIHIAEALGIPYFRAFTMPWTRTRAYPHAFVMPESKMGGAYNVTSYVLFDNVFWKTTAYQINRWRRNMLKLPNTSLEKMQPNKVPFMYNFSPSVVAPPIDFSDWIRVTGYWFLDEGQDWTPPQDLANFIAKAREDGKKIVYVGFGSIIVKNPAKMTQEVIDAVLAADVRCILSKGWSDRIVKGGPPPIADEPELPPEIFVIKSAPHDWLFRQIDAAAHHGGSGTTGASLRAGIPTIIRPFFGDQFFFGSRVEDLGVGIWLRKWGANSFGRALWEATHNERMIVRARSLGQRIRKENGVEMAIQCIYRDLEYAKSLIKRKPKEGEQPKDLDDDDEGEEESWTFVGRDEPDPEVLTRRLSDLWPGPEN

SEQ ID NO: 7893 - protein, 1448 aa, Steccherinum ochraceum
MSDDAAGHPITQVPEGPPEYPSNPSLDRSAELSTSPDARTGIMKRAMGKTADRLSRSRSAGKQTPSMTQSSPALPVSGHRRIFSLNRSKGKEKASTDDDLTTAQSQLVASPTSPSLPRRLSGRSTVAAQDDDSPFITPRSPPFGPTRSVFNIFRGDGSLRAGTQTLIQALQAIPWAGDDQDNDEDAANQETTDPESDDEDKPASWLASSIHTIYRPVARSRRKDRAARSRTEPQRMPSLSDAEDEPTPEEPVLSDEDIEEDFEPQSFDLHQSSEGQSTSMTLPPLPELDPPERSSIKPVPARSGSMATVKIQRRARLAEKLRDIFELKGISETKKCLVGFYGRFGYMYLTDSYLCFFAHLPSREDQVLKSGSLSKRAQRTKRWIKHWFTLKNDVLSWYQSSSDPYFPKGVVDLRYAISCDSVGEKDIRLRTNQKTIRLSADSVPSRDEWVKAIRKVMFKAQNMGDSVKIAIPYSAIVDIERSSAMDFSETIEVKVVDKGESYSVDSYFFAYFHDLQAALEQIRDAVRSSRGVPGDVTPPSVIDTTVSRSPPVTPNQTDKVAWASSPDSIPRASGFRFTSLLKPLQDSLPMSRTASAPEPIESPEEFTHVTKRSSTTFVPITTSPKSSFRLDSPPAARPSLITESSSSSVTPTASYISTHTYPPSSSLSPSISETGHSASSNTSTWSVGVPSWLKMPSTRRLLTSPFSSLSSRPSTDHAATLPASGSAKVTEVLSQSYLSPSSTSRPFSGEFGFYSILEAPGFPMDSDIVEKFRSSFAFDEKETLLGYFPGYIFRLLPVYGRLYISTNYFAFKSSGPLTSRTRMILPLRDILSTESSKAFRFGHYGLVVIVRGHEELFFEFADEERRTAFVSLLEKQSEDALGRAAAGEAHHTRTEGQRDALILEEFGPRAQITESEVMPEPENLDGSLPAVMFTSTSSTFLTFKPKEPLHLTFLTIGSRGDVQPYIALAKGLIADGHKCRIATHGEFKEWIEAHGIEFGYVGGDPAELMRICVENGMFTVSFLKESMAKQFRGWIDDLLKTSWEACQGTDVLVESPSAMGGYHIAEALRIPYFRAFTMTWSRTRAYPHAFAVPEHKMGGNYNYMSYVLFDQVFWRGTAGQINRWRRNTLGLPSTSLDKMEPHKIPFLYNFSPVVVPPPLDWPEWIRVCGYWFLDDANVGAAKWSPPPDLLEFIETAHKAKRKVVYIGFGSIVVSDPKAMTRTVVEAIVQSGVYAILSKGWSDRLVKTATTEVAEVAEPLPKQIYQISSIPHDWLFKRIDAACHHGGAGTTGASLRAGIPTIIKPFFGDQFFWADRVEALGIGSAVRKLTVPHLTEALIAATTDQKQIDRAKMIGENIRAENGVATAIEAIYRDLEYAKTLIKGHAIASEHREEASDPEHSTIRSYRGHSPARTGTHSGNSSFDSTNRGAVSDWSVISDSEEASAPTHS

SEQ ID NO: 7894 - protein, 1206 aa, Friedmanniomyces simplex
MASSRQSTGSLKAKVRQGINKVRDQRRVSMDVPERFQIEDNEEDVTAVNEDNQGYAQQSLYGMIGATHSRSGLQLQGHFQPDSGSESGGETETEGSGRNSKVPSTAASQASSNRSSVDEQRQSPKPEASRHRKNKSEGKGLRSFLRPIRERSDSQPPEFMTHSGFLPAREKATEEPERPASAGGIRSDAPMLDRKLHARARAEMDASTTSTTSRRSKEGSSSEGAKKRASAVDLPAAVAGIFGFREPEDIICEYPCWYLQSVLLQGYLYITKKHVCFYAYMQKKGHATIKSGQLAKQGKRNPRYRRYWFALKGDVLSYYTNAADPYFPSGTVDLRYGISADLVPEKGQDKPKDTCLFTVTTDNRTYHFRADSATSAKEWVKQLQKVIFRSHNDGDSIKISLPLENVVDVESSPLNDMAETIRLRVIDNDQTYSVDEYFFTFFSHGKDALHLLNVLTADNEIRKAPQGKRGLSYLGSSPKDYYTKFSGAMAGGKRHYSEADGLAPEDRIEDPEDDLDTVEHERRFQQHFALPESERLLAVYYGSLHRVLPLYGKVYIGTRNFCFRSLLYGTRTKLVVPFKNILNLEKEKGFRWGYPGMVVVIRGHEELFFDFSSNGLRDDCVVTVLRTLDAVRALQESVILTVDEKKDADAAAAENSLLSGARKDVLADRDAELSETLGQIESDTPIIFDDPNASILDFKPTKAMRITCLTIGSRGDIQPYIALCKGLLADGQRPRIATHQEFKGWVEKHGIEFAPVEGDPAELMRVCVENGMFTPQFLYKATSQFRQWFDNLLTSAYDACKGSDLVIESPSAMAGIHIAEALGIPYFRAFTMPWTRTRAYPHAFAVPSRKQGGAYNYMSYAFFDNLFWQISASQINKWRCKHLGLKPTSLEKLQPNKVPFLYNFSPSVVVPPLDFSDWVRVTGYWFLDEGTAWPPPDDLMAFINRARADKQKLVYIGFGSVTVSDSKQLTQQVVDAVLKADVRCILSKGWSDHFDKKDASVPEVPLPPSVFQIRSAPHDWLFQQIDAAVHHGGAGTTGASLRAGVPTIIKPFFGDQYFFATRVEDLGVGIHLRKITVNSLGKALWIATHDDRMRGRARVLGEQIRNEDGVATAIKAIYRDLDYAKTLIKKREVKIDGGGEVEDTEEAWTFVENDSDGDVARLGEPEVSWSSSTQGLRGWDGGGGVGGRGKRTSLGSMVLKAGQKAR

SEQ ID NO: 7895 - protein, 1316 aa, Jaapia argillacea
MRAGTQTLIQALQSIPWADDQDNDDEIVNHNISAAEIESDEEDKPSVQLSSSLHTIHRPMARSRRAGTNLKAVFNGSDTSEPSDDEQEPDQIYTSEPEDTDFEVATPRIPDHTRTTSNPEGRNTIPSRSIHGRMGSHSTVMTRTGSMATVRLQRRARLADKLREVFDLDGIEEVISEMPCWLLRSVLLQGYMYLTNSYLCFFAHMPAREDQVLKSGSLHKKAQRTKRWIKHWFVLKNDVLSWYQSSSDPYFPHGMVDLRYAMSCEHASEKEFRIRTNEKTIILAADSIPSRDEWVKAIRKVMFKAQNRGDSIAIPYSAIIDVEKSAAIDFSETIEVKVLDKDENYAVDSYFFAYFHELPVALDQIRDAVRNNRAVSQTSSPLPVMDTTTPRVSTALPVGPTHPTTERAQTVPTPDTPRASAFRLASLWRPFQDSPPIHRATSAPTPERPEENEEFTHISKRTSFIPHTSSPDDLTHAESSDSSLARPSTDNNTPKLHPSVLSVTDHTYPPQTTPGFYDLPSKDSSSSSWGVPTWLRVPSRKVFTAPFGSSSTTEHGSTVPIASVTEIYSTNESPTSSNQSGETGFSVLDVPDATIDAAITAKFRAAFALDDKEVLLGYFPGYIYRLLPVYGRLYISTNFFCFKSSGPLASRTRMMLPIRDVLATEKSKAFHFGHFGLVIIVKGHEELFFEFGLEERRVSFIHLLKRQMEDSQRRLANGESPTPGRREASILEAFDSRTSLVRANEPKPPPESMTESLPAIMFTSASSTFLTFKPTKSLHFTFLTIGSRGDVQPYIALAKGLKADGHRVRIATHGEFKQWIEAHGIEFGYVGGDPAELMRICVENGTFTVSFLKEGLMKFRGWIDDLLKTSWEACQGTDVLVESPSAMAGYHIAEALKIPYFRAFTMTWSRTRAYPHAFAVPEHKMGGGYNYMSYVMFDQVFWRAISGQINRWRRNQLGLASTNLDRMEPHKIPFLYNFSPVVVPPPLDWPEWIRVTGYWFLDDAEVGSKTWDPPPSLVKFIDSAHNSGKKVVYIGFGSIVVSDPKAMTHCVVEAIVRSGVHAILSKGWSDRLHKTGSEVSKPEEPLPEQIYPINSLPHDWLFNRIDAACHHGGAGTTGASLRAGIPTIIKPFFGDQFFWADRVEALGVGSGVRKLTVEGLTEALVAATTDPKQIARAKILGEEIRAEKGVATAIEAIYRDLEYARSLIKRGAPEDVVPDVENTALRDSQDSTPQSTLERPGTGDSSSERASEDWSVISEHEGQRRTSFGSRQSEIKADQTAAKRSSLSAAVLSVFPTGLTIGSPLSSPRSPSRPRT

SEQ ID NO: 7896 - protein, 627 aa, Solanum lycopersicum
MDQTSPEVSMAEPSTKFNKRSSSSSSGELSVTVVKEDDISTAGAGADVGSREEAVGGSASNGVTNSSGTSGMELTRVSTLPSENPQSPSDQPKLGRSKTEKPTHSSGFAQEAAKIFDDKISEQQKLKLLKRIATVKDDGTVEFEIPGDVETTEVLGTGSESVHTAVEDEPLDATELQYFPPMQIVVLIVGTRGDVQPFTAIGKRLQDFGHRVRLATHANFKEFVLSAGLEFYPLGGDPKVLAGYMVKNKGFLPSGPSEIPVQRNQMKEIIYSLLPACKEPDMDTGVPFKADAIIANPPAYGHVHVAEALQIPIHIFFTMPWTPTSEFPHPLSRVKQPAGYRLSYQIVDSLIWLGIRDMINDLRKKKLKLRPVTYLSGSQSSELDIPHAYIWSPHLVPKPKDWGPKIDVVGFCFLDLATGYEPPEALVNWLKAGPKPIYIGFGSLPVQDPQGMTDTIVKALEITNQRGIINKGWGGLGNLAEPKDFVYLLDNVPHDWLFLQCAAVVHHGGAGTTAAGLKAACPTTIVPFFGDQPFWGERVHARGVGPQPIEADQFTLDKLVHAIRFMLNPEVKERAIELAKAMENEDGVTGAVKAFFKQLSRTKNEPPRLPKPASTFSLRSCFGCSST

SEQ ID NO: 7897 - protein, 624 aa, Lotus japonicus
MADLPENRRRSSSSSSSSSDLSVRVERELGDGNNGSTGKDVEEKSDAVGNGDSIDNCGSSSSVSGIPGGLPKVTTLPPDISHGDKSESSPSNFKLEKSKTERHRHLRPGDAAQIFNDKIPVQEKLKLLNRIATVKDDGTVEFEVPGDVEPEAFGARSKHVNNVVDGSLDATDLHYIPPLNIVMLIVGTRGDVQPFVAIGKRLQDYGHRVRLATHSNFKEFVLTAGLEFYPLGGDPKVLAGYMVKNKGFLPSGPSEIPVQRNQMKEIINSLLSACKDSDLDSGVDFKADAIIANPPAYGHTHVAEALKIPIHIFFTMPWTPTAEFPHPLSRVKQPAGYRLSYQIVDSLIWLGIRDMINDLRKKRLKLRPVTYLSGSQGSDTDIPHAYIWSPHLVPKPKDWGPKIDVVGFCFLDLASNFEPPETLVKWLEDGDKPIYIGFGSLPVQEPKKMTEIIVEALETTGQRGIINKGWGGLGNLAEPKDNIYLLDNIPHDWLFLHCKAVVHHGGAGTTAAGLKAACPTTIVPFFGDQPFWGDRVHDRGVGPPPIPVDEFSLPKLVNAINFMLDPKVKERAIELAKAMENEDGVTGAVKAFFKQLPQTRNKTEPDQQPLPSSVFSISRCFGCS

SEQ ID NO: 7898 - protein, 1441 aa, Phytophthora nicotianae
  MOD_RES (1106)..(1106): Any amino acid
MPRECKFHEWNQRFKATLHKESKALAIAPPSEDVRTAGIAVHGPDGRIKVDVAEEEEIDLDALRRRSRSTIDEEDDLLLERASLNGPPQLNICIMIVGTRGDVQPFLAIAQRLQQDGHRVRLATHAIYRDFVTSYGVEFYPLGGDPKELAAYMVKTGGHLIPTKVETIQKDVPRNLQMIDEILHSTWPAVSAADPEGGGPGVKGKPFRAQAIISNPVTYGHIHVAERLGVPLHIMFPQPWVPTTAFPHPLANMPYTGKAQKRNYLSYKLVDLLMWQGTEGIVNEFRTEVLGLRKIRKGDGGRDILLDLHIPHAFMWSPELVPKPKDWGDLYDVVGTVVLKGTASSYTPTPELEAFLGTDEGPIFVGFGSMVLEDPKATTKMIIEAAKQANVRVLIQSSWSDMAGDLTIPDNIFFLGNCPHDWLMPRVSAVVHHGGAGTTAAGLLAGKPTFIVPFFGDQPFWGWAVQRAGVGVTPCPIEELTTEKLRAAFESLQSTEMRSRALGIQQKMQQEDGAEEAVRCFYRHLPVQDMRCDLDHVRVATKWCRKNKLKLCEVCDFVIASQPQNFARKVVDYHFVDYTARGPAHGFAGASAGAAAFFHELGGAFKDVVVKPARGFREEGPKGAVIGVVKGVSGLVIRPVHGVALFADHIAAGHANYFNETGRRKRGSVFDKTFMAALGKENGLIDSYTSGGSTEEIETHRCIGPKREVRRKVELNVSDEDKLKYQARFREIMSEKENHRDSLDRIDRNSSVSSNGSDAESESSPREGISILSADFTATGNIGVKFNVGPKSPDTISESKIEEWRQYSKLQRVKSERILKIFLGTTVPSMNICLATIGTWDNNVKQLVAIGMRMAADGHRVRVAANEEFRADIVERGLEFYPLAGAVKNIHDFIKYLHDTKNANVIQKHKAGRPVLGPFKDLVYSLWPAANGADPHGRGQNIPGEHFRADALFWHPLLFGHIHIAERLGIPLQCFSLVPLSPTFAMPHVLSAFLMDDISQLGREFKKTNWLSYGVVDTVLWRGMEDILNDFREHIGLRGHCHQASPLVEWRIPHVYLWNPSLLQRPVDWGRELSVAGYVTLKDEREMEKMRKFKWSRSLNDFTLEXCNPVLYFGVSTYCLESLQIDQLLRQIDEAAEQANVKIIFQAREGRSGRSLYHSENIYEVESDFPYSLILRKVAATIHWGEPAIVEEGLAAGKPVGICVSVSSQYYAACMCVTAGVGIPPIDLRKCTVESLVSSFKHILQPEIRDKAQEVSQTFQPKQALEKAVESFYMNLPLRAMRCDIDKDKVARIYDPRLELKLSFEAYIAIQPLRTHDDTDDVSYKPLWYDGRRPAKFSLRDIAGDHEPRDQKPIHGLESIRKALTSFASHESTDSAPEAPRSVLSRLTSRVAMVVEKPQYWSTPEQEVIESKAIVAAYERALQQRATQQPKSKPRKRSMHH

SEQ ID NO: 7899 - protein, 1279 aa, Puccinia graminis
MDPPTTPIPGPSSPPFSTGPSLHSTPVRPSLSFAHHSLGSTASFVGILKAAALSELENSDFYGSSRSPDKKASIAQQKNSHKNLKAKLELDSEDDDEDAEEEEDDDDDDEDAEEEGTEDEDDDGESAQDDLVDTPPELSPKFNSFRGPSQLGYPSPKALQGLACELINQQKRVADLAVRKGINSSTFTPEPSSHRSSLNQSTPRCSSPLQISRKDYSGSAPITVSDSNNTTQSSCADSESHVSSEERLHRLEEQFGVWPGKDAQGQPETESWIAQVPGVLYRSVLVNGLIVLTDRRLCYLAYLPTFDKGQIIRSGSVTVKADSRFNKRRRRWVELRTDSLTEYRLSTELFRPLSSYHFSEIQRILPISSGQSRTLSLRLLDGRLIVVDFDTSEAADLWHQDFVRALFSFKTDYSNQIKMMLPLSRINSVHRETFESIAKMMVFEVDCAPSFCRSAKSDVIEQHSDHPSTPERPRIELSYYLKHDPFDDTVIDAITHAKHNASQHLFPDSTPAPLLELLDHSPAEDEAEAENITSGKADSNNSCNSKLANRFMKAFGLDASEKLTVYSCALLRTLPTLGHMVLSNDYFCFWRRGTVITQDYKLRIPIKDIGQVKEATAFGFTRFGIAIELAGAPDIRLDFSSKSTREEVMQALEDHAQAAKAEEKRINRRLSNMPIPKPLGQNTEQFKLASPALKKQRPVVIDKQQIERPVKAMKIICLAIGSRGDVQPYISLAKRLMQDGHTVTIASHPEYRPWVESFGILYRDVGGDPAALMKLSVEHPFFSTGFFKEGLGRFRTWLDDLFMESWLACRDSGAELLIESPSTFAGIHIAEALRIPYFRAFTMTWTSTSTYPQAFASNIDLGPSYNLLSYSLFDNLIWRAMSGQVNRWRKQTLKIPSTSLEKMQPYKVPFLYNFSSVVVPKPLDWRDHVDVTGYWFLDQSHGEYTPPADLVAFIDAARQDQVPLIYIGFGSVTVSDPTAVTKAIYAAVVQAGVRAIVAKGWSERGNTKNSLDDAPIDPPAQVYDLHSVPHDWLFPQVDAVCHHGGAGTTGISLRYGVPTLIHPFFGDQPFWADRVTKLGAGMRVDSLTTQSLSDAFIKATGDRIMKEKASQVGEKIRAEDGPTRAVNFIYQYLDFALERTEHRIARTSRKKRWVSSVSGCAASQPAASVDGSHPELESPALRKADLPPCSASFENEDPNHLSDSSPDSPSLLPANAQGKLADPPQSPDDGTLTRKKSIAGGPIRSYSHLIKIPNAISPVKSWSKIKKIFLHPKVIPNVG

SEQ ID NO: 7900 - protein, 724 aa, Neofusicoccum parvum
METVRAAAPWTFAMKGRHSLQPDEGPADFPPSYQEATESLLQASAAVRHDGRVDVDLDSKLGRTLSRLFAHPPQIVPSAPPPAYVAAPEFPIRLNIVIQVVGSRGDVQPFVALGCELQKHGHRVRLATHDVFDDFVRKSGLEFYPIGGDPAELMAYMVKNPGLIPNIKTLRQGDIQRKRTMVAEMLHGCWKSCVEPDPLSEAPFVADAIIANPPSFAHIHCAQALGIPVHLMFTMPWSSTRAFPHPLANLKYGSTDPGMGNYISYGIVEWMTWQGLGDVINKWRHSIDLEPVPATEGPNLAETLQVPFTYCWSPALVPKPLDWPSHIDVCGFFFRDPPNYTPPPDLDAFLRAGPPPVYIGFGSIVLDNPESMSATILEAVRTQPFWGNMVAAAGAGPVPIHHKSLTAQNLAEAITYCLTPQASAAAGIIAEKMRAESGVSSAVASFHANLPLEKLQCSLLPDQPAAWKLSKGKGRDKKKYRLSKLAAEILIQDLGLDRKNLKRYTPNPIIIDNTRWDPVSGTSSAAMGTGSDMLMAAAGIIVDPIREYRRGHSPAPSRPESPRPSNSSKTSVTATATTAATTAAAEAAATPKNPDALALIPTTPHDPTTDRDEGPSNRNTAAAMAAASGKSLGRFFGAYGRGTFVDIPLALTEGLRAVPTYWGEEVRDHGKVDGWRSGAVVAGKTFAYGVGEGLTDVFVQPYVGARREGAVGAVKGLGDREERA

SEQ ID NO: 7901 - protein, 1451 aa, Claviceps purpurea
MDTIPALSPNCDREGTAVETSTSNGTGHHSHSASLDLPEPLRQSDTDDETSPNDTTSHRGRAVSVNMNQSIFGLIAAAGSRVDFNTRFDDGSSDDEDGDDATRPESQDLSKTVVLSPRTMDERDGHKKKLSTGQRLLKSLSTLPRRKLKKSQSSRADTAALEVSDDANESTEDPPTPTGAVDVEHSRRLAPVMSRMLQARAQMAARLSFDMERRSSDMAASGDSDESSALAKRLMEIFQFDEPEQVIEEYPCWLLQSVLLQGFLYITAKHICFYAYLPKKANVVAKSGYMFKSGKRNPKYHRHWFRLKGDVLSYYRDSTSLYFPDGQIDLRFAISASIVDKDKDGLHFNVITRHRTYNFKADSAPSAKEWVKSLQRVIFRSHNEGDSVKISLPIDNIIDVEETQMMEFSDTCKIRVIDNDETYAIDEYFFSFFNFGREAINVLRILIDGASSSNKTAGQRIADEEQVLQDTEIRPNSQHLPRQSSPLLSQHSTRQSGQIDRMHSTKLPEPVKATLAPLSPAQTSGLSPRASLECSSRPSMDGRRQMGRRSHEVSSLMREHSPRRTFSAPRRTKSSRRVEETPKHLFNSTESNWQMSTEDPSFSNLTMSAATDDPTASQILQTSEVFRSPTMRRSDESSQNANGKGHDRPVGAESLPTASCPPKHSATTGHMGQLGYHGKDAQQLPRATTPTLQSITKMGSYPLQRAGALADYLNKTSKRMSSLLATESMGYVEKVSGMWKGGRKHYGEHAELRPDEDELEEDSDGKVQTSMERFRAHFALPETEKLQATYFGCIIRVLPLYGKIYISDRSFCFRSLLPGTRTKLILPLKDIETAHKEKGFRLGYSGLTVVISGHEELFFEFSQVDVRDDCTVTLLQSLETCRHLRDSGILHQEEKEQQEAAMAERDALRSARRDEFPQHDMQPPKEAELQPSAPTILMDDPDGSFLNFKPPRSLRITCLTIGSRGDVQPYIALCKGLLAEGHQARIATHAEFQGWIESHGIEFRKVEGDPGELMRLCIENGTFTLSFLREANAAFRGWLDELLDSAYAACEGSDLLIESPSAMAGIHIAEKLGIPYFRAFTMPWTRTRAYPHAFIMPEHKMGGAYNYMTYVMFDNIFWKATAQQINRWRNKSLGLPNTSLEKMQPNKVPFLYNFSPSVVPPPLDFSDWIRVTGYWFLDEGGEYDPPKELSDFIQRARQDGKKLVYVGFGSIIVNDPAKMTQEVIDAVLKADVRCILSKGWSDRISSKGDATATQSPQQQQQQHEEPEMPSEIMVIKSAPHDWLFRQVDAAAHHGGSGTTGASLRAGIPTIIRPFFGDQFFFASRVEDLGVGVGLRRWGSKSFGRALWQATRNERMIVKARVLGEQIRKDKGVDTAIQNIYRDLEYAKSLIKRKIGHNGQLDAEEDDEAEESWTFVGAEEPDPDVVTRRLSEGLGGMVLGEQRRLGGRAVKT

SEQ ID NO: 7902 - protein, 1477 aa, Bondarzewia mesenterica
MSRLSKSQLFTPKTSSVPNLSSSVPDRTAVDEAEAPERSSGSSSPKEAVRRVIGKTGFGGSKSAEIKSQRASRPKSPTGPRRMFSLTRRSKDKQNPSDIGSGDENSGFVRHSSLRSHPGSPRSTSADVPSEANDESPFIRPPSPSQNPPRPSLQAFRGGGSMRAGTQTLIQALQALPWEEDPDNDDDIIHQDLSPVESDSDEDVKRDQPMASSIHTIYRPVALSRRAESQSQLSTISSHSDDQQDIAGSVGASKGSELSDEEIDEDFEVSSSGTSSPVGHRRKEGPQSVLTPVLEGAIGSDSSRIRHGRKPSSGTVKTIKLDRRASLAAKLADVFELSGITEVIAGKNALLVDEVHPPTRTYISDKLISVLLRSHAFERVLKSGSLYKKAPRTKRWIKHWFVLKNDVLSWYQSSSDPYFPHGVVDLRYAISCEHANEKDIRIRTNAKTILLSADSLPSRDEWVKAIRKVIFKAQNMGDTVKIAIPYSTIIDVDKSPAMDFSETIEVKVVDGSEDLSVDSYFFAYFHDLPAALEQIRDAVAKARRFSPHGSEVPTPEQLIDTTVPRSATMPRVGEERTLSAVEQLPKANSTFRLSSLLRPFQDSLPIGRSTSAPDHLDNGEGFTYVQKRNSSSFIPITTSPLSESPPLPSTSSSTNSSIHDQATHSPGSLTPTPSQAGHTYPPLTSANELYLPPVREPSSSSWNVPVPSWLKMPSRRVFPFGGGTGIAHADTLPVDGNGITEVYSSTTSSGSGVSNAPGELGFSILESPDNAVDAETSEKFKVAFAFDEKEALLGYFPGHIFRLLPVFGRFYISTNYLCFKNSNPLASKTRLMLPIRDILATETSKAFRFGHYGLVVIIKGHEELFFEFGQQDRRAAFVHLLDRQIEDVRGREPTARSQGQRDALTLEEYGSNTPFKDDVDPMHAPETMSGSLPANLFASLFLTIGSRGDVQPYISIAKGLMADGHHVKIATHGEFQSWIESYGIEFAYVGGDPAELMRICVENGTFTVSFLREGMQKFRGWIDDLLKTAWEACQNTDILVECPSAMAGYHIAEALRIPYFRAFTMTWSRTRAYPHAFAVPDRKMGGSYNYMTYVVFDQVFWRGTAGQINRWRRNILGLPSTSLDKMEPHKIPFLYNFSPIVVPPPLDWPEWIRVTGYWFLDDANVGAKKWTPPPELVEFIDSTHSSGKKVVYIGFGSIVVSDPKVMTRCVIDAIVQSGVHAILSKGWSDRLTKNVAEVAEPEEPLPKSIYPLASVPHDWLFKRIDAACHHGGAGTTGASLRAGIPTIIRPFFGDQFFWADRVEALGVGTGVRKLTVDNLAQALITATTDVKQIARAKLVGEQIRSENGVTTAIEAIYRDLDYARSLVRHTPRDNEGTDIEDSAIREHDKSLSSLPSRPETRSGDSSGGGAPSEDWSVISDQEDPRSSVSSSRNSEGRDRMLTTKRSSLTAAMLSVLPDVLTASSHRRSRSVSSVSTS

SEQ ID NO: 7903 - protein, 331 aa, Unknown
  Description of Unknown: Oryza sativa Japonica Group sequence
MEAEVASALVGTCMPCNQFVLSYQIVDSMIWLGIRDMINEFRKKKLKLRPVTYLSGAQGSGNDIPHGYIWSPHLVPKPKDWGLKIDVVGFCFLDLASNYVPPEPLIKWLEAGDKPIYVGFGSLPVQDPAKMTEVIVKALEITGQRGIINKGWGGLGTLAEPKDFVYLLDNCPHDWLFLQCKAVVHHGGAGTTAAGLKAACPTTIVPFFGDQPFWGDRVHARGVGPLPIPVDQFSLRKLVDAINFMMEPKVKEKAVELAKAMESEDGVSGVVRAFLRHLPLRAEETTPQPTSSFLEFLGPQKAYVDDVLQFVVWRMNTTRWVTHVLTTNAGM

SEQ ID NO: 7904 - protein, 1406 aa, Aspergillus clavatus
MRPFLDDAKRRVDRRLSASKQSISTSRLLPSVLPDRFKDNHDAQVDFTAPPGGVGSREGHMQYMQQSIFSMIAAVGSRSDFHARFDESSDSDGETEGRSQTESPVKKVLGSSNPVNSQTEQRSGSQTSRKSEKDQSSRGRHHRRTISDHKFLRPFKTSSKPEPDTEPSTGDERLRVTLPRRPRSTTPRAAPILSRMVEAQAQFDSKTPSAGRSQNSSQESSIHSSHESSTSPLSTRLMEMFDFNKPEKVLVEYACSLLQSMLLQGYMYVTEGHICFYAYLPRKSTVAIKSGYLHKRGRKNPKYNRYWFSLKGDVLSYYADPSNLYFPSGHVDLRYGISASLAESKEKGREPKEFQVSTDQRTYHFRADSSVSAKEWVKALQKVIFRTHNEGDSVKVSFPIENIIDIEESPMMDFADTFKIRVVEDDDSYAIDEYFFSFFDSGREALTLLKSLVNENASGHSSRTLSPHADRSPRSDRTRRSRNRWSLTSGTSQPGNGSADTHRKRSASTSHLSLGPDAIPTSPVTRHQDPSESILNSFEQGTESSAVWQSMEDGAESASQILHRSDVFQSPTIHNLDKRACSDERSGRRQAGGTARSTLTHVNANKDGSPGEYSKLGNDGKPDREIRHVIHELDQETQGPSKPGPGAPTLNELVKAGTYPLQRAAGFAEYLRTRSKQMSNLLASESMGYIEKVSGMWVGGRRHYGEAEDVLPDDQAVDPEDKEDGCNYGDRFRAHFALPSTEKLQATYFAYLHRVLPLYGKIYISQKKLCFRSLIPGTRTKMILPLKDVENVEKEKGFRFGYQGLVIIIRGHEELFFEFRTSDARDDCAVTLHQHLESVKYLAESGLLAEQEKDESEAAMAEHRMLQEARLDDYGENDIPPLNESSGLHPIFDDPRASIVNFKPAESLRITCLTIGSRGDVQPYIALCKGLLAEGHKPKIATHAEFEPWVRRHGIDFAPVDGDPAELMRICVENGMFTYSFLKEASQKFRGWIDDLLSSAWASCQDSDLLIESPSAMAGIHIAEALRIPYFRAFTMPWSRTRAYPHAFAVPEHKMGGAYNYITYVMFDNVFWKAIAGQVNRWRKNELGLKATTLDKMQPNKVPFLYNYSPSVVPPPLDYPDWIRITGYWFLNEGVDWTPPVDLSAFIQRAREDDKKIVYIGFGSIVVSDPSALTRTVIESVQKADVRCILSKGWSDRLGDPSSAKTEVPLPPEIFQIQAAPHDWLFAQVDAAVHHGGAGTTGASLRAGIPTIIKPFFGDQFFFGSRIEDLGVGICMKKLNVSVFSRALWEATHSERMIIRARDLGAKIRDEDGVATAIQAIYRDLEHAKTLAQQRSIASSTPFSPTPSAKNTAEQGDDDVEDSEEWTFVGDDNEMDMSRRMRDRAISDAEMLPDRLLTNSIHGAGR

SEQ ID NO: 7905 - protein, 1420 aa, Oidiodendron maius
MSPEEEFKKRVMRKLSKRRKERHRATVDMPERFRDGEDADEDCTAPQGANAYMNQSVFGMIAAAGSQVDFNARFDAISSDEEEGSGPAPSRNLDSQAIKPSQDTTTSTKGGRQQRLSEYAVMEKSEESSRSKPASWSPPAAPMQALELPPEASTPDTPARMLLSSDASVMKRMLEARAEVSTRPSFDMPRQAEEDINALGDGSSESLARRLKEIFGFDGPEPVLSEYPCWLLQSVLLQGYLYLTTKHVCFYAYLPKKLNEVVKSGYLSKSGKRNPKYHRYWFRLKGDVLSYYSNPSELYFPSGNIDLRYGISASVADKDKGKDSTYFTVVTHQRQYNFKADSIPSAKDWVKALRKIIFRSHNEGDSVKISLPIENIIDVEDSQIVDFADTCKIRVIDNDETFAIDEYFFSFFSYGDEALSALKTLAEDTHAQHIPEGLLASPIATDERSSRHGHFKEGATKTSKSSKTTSTVSPFDDSVKATLSPIKSPSDLSPHGGADVRRLSSDAFQKIGRLSVDLSKLSIDGVRRRSASIGRRRSSSQNQIHADKGTVEKDDSPDSYVHSVGEPSSSSALPSASEDTQASASQILKGSDVFKSPTIRRSSSARRQRHDGSPSNRPIRHSSSTHVDISTVKSPSALAQVSIDMSNETQIESATSAPTLQSIVKAGSYPLQRAAGFAGYLNRHSKRMSNLLATESMGYVEKVSGMWKGGKRHYDDQPRLVDDGEALGDGNYDQSSVSEDRFRDHFALPITEKLQASYFGYLHRVLPLYGKLYISHSFICFRSLLPGTRTKLILPLIDIENVDKEKGFRFGYSGLVIVIKGHEELFFEFSQAEVRDDCAVTLLQNLESVRYLRESGLLTVEEKKSADTASAEHKALQVARNRSDANHDLKLPRNIEDTRNEAPPILFDDPRASILNFKPEESLRITCLTIGSRGDVQPYIALCKGLLAEGHKPRIATHIEFKGWIESYGIEFKPVDGDPTELMRICIENGMFTYSFLKEASSKFRGWLDDLLSSAWQACQGSDILIESPSAMAGIHIAEALRIPYFRAFSMLWTRTRAYPHAFAVPEHKMGGAYNYITYVMFDNVFWKAIAGQVNRWRMNELHLPATSLEKMQPNKVPFLYSFSPSVVIPPLDYSDWIRVTGYWFLDEGSNWSPPKELTAFIKKARDDGKKLVYVGFGSIVVQDSAALTNTVIKSVLKADVRCILSKGWSDRLDKKEANVVEAPLPPEIFQIKAAPHDWLFTQIDAVAHHGGAGTTGASLRAGLPNIIKPFFGDQFFSGSRIEDLGVGIYLRKLNVSVFSRALWEATHSERMIVKARALADQIRKENGVDIAIQSIYRDLEYAKSLIKDRGDKTVDDMNEESEESWTFIGDDNDPELIRRIHDWEAMAQSETASNHNVLSESEASGSRSLHETSATSTAA

SEQ ID NO: 7906 - protein, 420 aa, Tamaricihabitans halophyticus
MRVLLSTWGSRGDVEPLAGLALGIRELGAQVRVCAPPDAEFAALFTELGIPFVPLGPAVRSVTAGKTRPTTQDAFRLAAELVAARFSTLGAAAADCDVLLATGLMPAGARSVAEKLGIRYVFACFHPFGLPSRHFRPGERPGQPLPAGETDPKVLWDHDARRVNDLYRDALNSHRTAIGLPAVENVRDYVFGDGAFGDRALADGALADGALGDRPLLAADPILGSWQDSTELDLVQTGAWIRPDERPLPPELVEFLDAGDPPVYVGFGSMAMRSSPDLAGVAIEAARAHGRRLVLARGWAELAPSDAKADCFVVGEVNQQALFPRAAAVVHHGGAGTTTTAALAGAPQVVLPQIADQPHWARRVAELGIGAAHPGQPSTVESLSRELRTALDPETRVQARAVAGWMSTDGAAVAARLLVR

SEQ ID NO: 7907 - protein, 1023 aa, Dictyostelium discoideum
MFQNCSLYYYSYDSNVEGIVYITKSYIAFNPSPLDKQQQQQQQQQQQQPNSSSITSTTYDRDLDTDSDTDSESDFDYPKQSQHDNSVVMVNNNQYKVKEVLMKKALIPIEDIVSVTKERFLLFFNQCVKIITLDHKWIFGSLNNINSFYNLILETWKQIPKTLLDSSSSSSSSSSSSLLSSSPNNNNSDLNINGNSEGSIFTPLESIKIKNKLGLPADEVLITWFNCTNFKGAQLKYGFLYISNNNICFRSKFGFQKRTIVIPLSQVIEIKKYSAFIPNGIKITTASHHEFQFASFIHRNRVYQILYETWLKANNKKSNSSNSLSSSPTITSPLAISPSIASPSITPPSSTPPSSTTPSSTTPTITSPTIHSTLPSTVVYNDIQEIIDGENNSNNNNNNNNTNNTNKSNSFIGNVEEDVDKIKRSIKSLPILKIHSAQQQQQQQPKTTTTTTSTTTTNLISPRLLTPLTITQSPGFSSLVNSPILPVKPLRITILTIGSRGDIQPFIALSLGLKEYGHNVTLATHELYRDLISKEFGLNYQPLGGDPRELMDLCVRNGIFTPKFIKEALSRFRSFIDDLLLTCWKAVQNSNTQVLIATPGCFAGPHIGEVLQIPFFNAFTMPFTRTRTYPNPFAPFASHQMGGVFNLATHVMMEKVLWQPISGQINQWRTETLKIPPWNSSVSINETYRMPYLYCFSKYLVPKPPDWSGEIAITGYWTLKNQANSDSPPDDLIQFLNEESSTENDDIPIYIGFGSIVIDNPTALSLLLIEAIKLSGKRAIISQGWGGLSIDEHNNNNNNNNNNNNGENSDSNKSSLQSNRIYLLKKPVDHSWLFEKVSLVISHGGAGTVAASLLAAKPTIVVPFFGDQFFWGERIKQTGIGTSIPFDILTAKSLSSHIISILNEPSVRAKVNKMSHLLKREDGVKTAIDFIHRYLPFSFIPPREIPFSSAPNSCMGCKQPFTLLHVMKARVHCHCCGKIFCESCTSHKCPIKKYRINTPVRVCDKCFNDLQSNPSSNSFILND

SEQ ID NO: 7908 - protein, 428 aa, Rhodopirellula baltica
MRVWMRILVLTVGTRGDVQPYVALAVGLKKAGHEVQICTCQIFEEFIRSHGIDYAPLNNDIRDFMESEDGRVAMETTTNLFQAVRVGVRLMPKLTGMMHRQVSEMWAAADAFQPDLILFHKKAIGAEDFAERLGCRCALAFYLPLYVPTGESPAFGFPRLPLGRWYNLATYRVIEFITRRSGGRFVGKWRRSQGMSKKRPPYFQHADGSPVAALHAYSPSVIPRPSDWPDHAMVTGYWFLDGATEFTPDPRLLYFLQQGPPPIYVGFGSIFGRDPRATAERVIEAVRLSGQRAILAPGWGGMDLREFDFPETMLSIDAVPHDWLFPQVSAVVHHGGCGTTAAGLRAGRRTIICPFFGDQPFWGRVVHELGVGPKPIPQRRLTPERLAKAISETIDDCEMESRAEQLGKQIRSESGVQNAVRFIDGRNV

SEQ ID NO: 7909 - protein, 885 aa, Trichoderma virens
MLLSRTRSNAAGHIAIDDGLTKDVTSGNVGADGRFELCFHQDAGSLATWCKNLQESSKRVQTGPCSTPICGRRKSTGGFCPPLNIAIHIVGSRGDVQPFIPIAQILSKPPYGHRVRICTHPAFKDFVESQGIEFFSIGGDPEALMSYMVRNPGLVPSRKSVKAGDIGKRRDEMWEIINRAWRSCIEAGDGMGEPIKATDVENVEDLFLADAIIANPPSLAHIHCAEKLGIPLHMVFTMPFSPTTAFPHPLASMNYSGTDPKTANYLSFIMMELLMWQGLGDLVNKFRRQKLGLDTISIMWGFQLLSRLRVPYTYLWPESLIPKPPDWGSHIEVAGYSFLKLASSYTPPPELTAFLEKGPKPIYIGFGSIVVENPDALSDLIFEAVKIAGVRAIISSGWSRVGSKCNVPEEIFLIDNCPHDWLFQHVSAVVHHGGAGTTAAGIAAGRPTVIVPFFGDQPFWGQMIARSGAGPDPVPFKDLTAEVLAESISFALMPSVQEAAQLMAEDIAEENGAEDMAKSFQDRIGLDQFECEICPGRLATHRHKKTGTRLSGFAVCCLVDRGLIQPPELEIIRRKNWYVDEGVEHPLVGFTAAFTDPMVDVATATFDYSHALRNRPQHTKHEDRRQSWIDPWGDKIGNGSVASNGTSPSRRINPTTFTRREMELYAQKVARKSLKTNNADVDTLIRQPSLYDKQKAAWHARERGRNGHLFYLTRATGRYAAELTKVGLKVPVAFFYNIANGFHNYPSCGYAGVEVRRRDQIIDFETGIVAAGKEFTLGIWEAFSGVVIFPYQSVHEEGAKGIGKGVWRGSKGFFSNLGASAFGLPGYTLKGVEKELQKHHITKYKAEIILIRLRQGIEAFRRSSQQERDKVIGCWKAHNCPKKQS

SEQ ID NO: 7910 - protein, 420 aa, Bacillus atrophaeus
MKIKLLTIGTIGDVKPFIALGKELSTRGHHVTICTGKAFKDLAEENGLFFSPIRADFVDLTQSEEGKRMLKGNPLSIFRQVKTVISPMMERMLVDIWKVTKDADAIIYHPKTLGGYDIAEALHIPAFIAHPVPIIAPTRHFTNPILPFSMRNGLLNKTSFKINRFVMSAFYSIINRWRQTTLGLPGKRSIFMDDTMLDNRPIPVLYGCSPSIIPFDEKWKDHVSMEGFWFLDEESWAPSPELLHFLEAGPPPFTVSFSSMPLSNPERVLNILQQAFKETGQRAILITGESGMKQIADGPHTFTAGSIPHTWIFPKSRAVIHHGGAGTTAAALKAGKPMVICPFSGDQPFWARKMKDIGVATAVPLKEKDMSVELFVSSIHEVLSTPSLTNRAAEAAIQIKKENGITRTADFIEEKMEEWS

SEQ ID NO: 7911 - protein, 608 aa, Eleutherococcus senticosus
MPEKDSSSSGEVPVNFEKEVAGGSSSGSELDSKEAVAGSLSNGGSKSPGNASRNFSRVNTLPPEILNSDKLMPPSSQLKLQKSKTERHRHDNILPEEAAQIFDDKIPINDKISLLKRIATVKDDGTVEFEVPEDVEPQTLVVQPENVYNEVDDDPLDSAELQDIPPLQIVILIVGTRGDVQPFIAIGKRLQYYGHRVRLATHSNFKEFVLTAGLEFYPLGGDPKILAGYMVKNKGFLPSGPSEIPVQRNQLKDIIYSLLPACKEPDVDTGIPFRADAIIANPPAYGHTHVAEALKVPIHVFFTMPWTPTSEFPHPLSRVKQPAGYRLSYQIVDSLIWLGIRDMINDVRKKKLKLRPVTYLSGSQGSDSDVPHGYIWSPHLVPKPKDWGPKVDVVGFCFLDLASNYEPPESLVNWLKAGTKPIYIGFGSLPVQEPEKMTKVIVEALEITGQRGIINKGWGGLGNLAEPKDTIYSLDNVPHDWLFLQCAAVVHHGGAGTTAAGLKAACPTAIVPFFGDQPFWGERVHARGVGPAPIPIDEFSLPKLVDAIRFMQDPKVKESAVQLAKAMEDEDGVAGAVRAFFKHLPFRKTAPEPEPVPSRFLSKCFGYF

SEQ ID NO: 7912 - protein, 1556 aa, Sporisorium scitamineum
MSTTSPKSPPQFPSSVGKEESRDASQVAAADLDPFTVDDDAQDDPPKPPPPAQIPDILDTPPFPTSPRLDPWSPRNYSTISSLAGSRELGRPALEPTTKIFTESSASAASPSAPPTRSAQTTTIDNEAAANADQPDVFDVSFHAEPQGLMQMLSLVGSTFFDADTEGYTEDDAEEIEGPRRSQDRNREQQGVVQDGPTQEAHSRQSDHDQHPFDRTVKGRLQALARDDGSDDGSTPQGSRSPLDASVLTIGPSRPKRTSLTQSDISSSRDSAVTRAARKPSNLRSQLHNVSTASMFASASQLSDSGHDQDVGEFRRGSSSFDVDPTDTQDTRVREQRGVSRLPSEAGRSSNRSLDPLLIRPYLEQQPSGQLPTDNSGMDRDRLLQQLKDVFQLDAAETLLLAQPCWLFRSLLLQGHLYLTSGHVCFYAYLPSRDEKTIKTGWLRKRTRRTHRFSKHWASLKAGKLSWFDSDRDPYFPQGHIDLRKVSAIERSNTHKDRFKVTTPARRFTFLTQDEQSRDAWVEALQKETFRAQNQGESVRISIPLETVMNVDTTLSVDGTEMVCITVVDEAGDFSVDEYYFLHLTKPSAFIADLSSLLEQAGRGSVASLLSGDQALNLSRLSIRDSTGATHAAVISRKSLEEVPVLPEVHVPTQRDKETAKLAEATESDIPQAGFPHSVSEDVSRRGSTDKQDEQPTTASTATSAIAVPMSIRKNSQEAPTDAILSTTPRAAALNRLSMESTHTYPPSPSVSDPPTSFDQVQREAERGWAIPDWLKSAPARVLGRGSDASSAATSLPKAPSTGASTRRRRKVLEQWSDDKGDDVSRGESSNTDNEDDILSHSIHSAQSNYSILEADGEEVEPADHASVAAEFRDTFGIGEDESLIGHTHAYLYRVLPVAGRLFVAESHLAFRSSGIAAKTVGRTLMLVPLQDVISAAKHVAFRPGHHGMVINISGYEELFIEISSAHRRDELLSLIEYQLEMIRGGRGSRQSREAVTRERSHALVLRDLSERINDGPAMASMTSSADSSMLSQTGSRLGSRSNSLSQVGGGSSFLSFSPAAPLTFTMLTIGSRGDVQPYIALAKGLQADGHRVRIATHGEFGDWILGHGIEFSEIGGDPAELMRICVENGTFTVSFLREGVTRFRDWLDDLLASAWRACQGSDVIVECPSAIAGIHVAEALQVPYFRAFTMPWTRTRAYPHAFAVPNKKAGGNYNYMSYVIFDQMFWRASSFQINRWRKTLLGLKPTSFDKLEQHKVPFIYNFSPSLVPRPLDWFEWIHVTGFWFLDNPDNSSSKEWEPPVELVTFIRRARERARKLVYIGWGSIVVPDAGAMMRFVLEAVRKSGVCAILSKGWSDRLSVDNKGRSAELDPTLLEDVFQVSSVPHDWLFPQIDAACHHGGAGTLGASLRAGLPTVVKPYFGDQFFWGQQIESLGVGSCVRQLTADNLAAALITATTNTKQIERARKLGEQIRSEDGIGNAIKAIYRDLDYARSRVKRDTRIVERESGDTAMYRKPMDEEQGSEEEDGGHTSDEWSDIGGAASPAQPPDASLSVVLG

SEQ ID NO: 7913 - protein, 793 aa, Colletotrichum fructicola
MSDSKKPMSSESDESLCDSPPPYELHSSGALLSSAAAISADGQVNIDFQSEYPEKLAEELPPFPDDDDATAPTFNDKTVPPLNVVIQVVGSRGDVQPFIALGTALRRYGHRVRLATHDTFAKFVMDSGLEFFPIGGDPADLMSYMVRNPGLIPSMESLKGGDVGRKRTMMKEMLHGCWQSCIEPDPISKEPFVADAIIANPPSFAHVHCAQALGIPVHIMFTMPWTATRAFPHPLANIQRGDNLEPQTTNWLSYGVVELMTWQGLGDVINAWRRKDLELAAIPASMGPGITTFLKIPHTYCWSPAVVSKPADWGPEIDVCGFFMRDEPSFNPPSDLDAFLASGPPPLYVGFGSIVVDDPARLTDIIIAAAKACNTRVIISRGWSKLGEGKPNTNDVFYLGDCPHEWLFKRVSAVVHHGGAGTTACGLINARPTIIVPFFGDQPFWGRVVAGAGAGPLPIPQKELSMERLTEAIQFCLSPAANQAVKQVADIMRRERGVDTAVESFHRNIPAASLLCDMLPEQPAAWTYEVKGKSGRKHLKLSNQAVTYLIDAKKIKASDLKPLRTKEYNTDVTRWDPITGGASSLLGTVTDFTVALGGTFIDPWKEYKRSRASGHEAGRASGSAALAAGKGFASMTGAVAKGGLVDMPLALAEGLHNVPKLLGDKPRDNGKVEDWKSGGVVAAKTFGTGFYDGITGVFTDPYKGAKEGGALGLMKGVATGSLGLFTKPGAGMFGLVAYPAQGIHKSLKSRTGRGHTVWQAKSDLLDRNRRKQREDSPRAGSKVLQVFDAYFAQ

SEQ ID NO: 7914 - protein, 418 aa, Actinophytocola oryzae
MICRPGRLTWGNGESEVRVLLTTWGSRGDVEPLAGLAVALRGLGVEALVCAPPDEDFVRLLARADIPHVPLGPSVRSVVTGPKPTARDAFQLAPALVAARFETLGAVAPGCDALLATGLMPAGARDVADKLGIRYIYGSFHIFGLPSRHFAPGMRPGTPSPREETDKRVLWQQDAQRVNDLYGPALNSHRAAIGLPPVDNVRDHVFTGRPWLAADATLCPSQGMTDLDLVQTGAWILPDDRPLPDDLDAFLDAGAPPVYVGFGSMAAHAPEGVARVAIEAARAHGRRVVLASGWAGLAPVDDAGDCFVVGEVNQQALFGRVAAVVHHGGAGTTTTTARAGAPQVVVPQIADQPYWAGRVADLGIGVAHEGSTPTVDSLSAALGTALAPETRARAGAVAGTIRDDGATVAAKLLLDAAS

SEQ ID NO: 7915 - protein, 1463 aa, Coniosporium apollinis
MDARRMSADKAGRSLRRPGRPLRRVSVEIPDRLKGGEDEEEDVTAPKTLETQYMNQSVLSLITRVGSNMDQRSHFDENQSSGSEDEDVPAQPRTAASTVLFTGAPRRGREQEREGHKSGLKPSHHRLFKSVPKLSLLRPIKERKAARTSMDGMSDSQILPEQQPEEDTAEQAHGVAPVMSRILQAEANMEASEGPRERRASERDVGQKIPRSKTPVSLPQKLMDVFEFEAPEEVIAEYPCWLLQSVLLQGYMYVTQKHICFYAYLPKKTHEVIKSGNLAKRGRRNPKYNRYWCVLKGDVLFYYSDPTELYFPSGTIDLRYGISAAPMDSKDALGFVVETHQRTYTFRADSATSAKEWVKAIQKVIFRAHNEGDSVKISLPTESVIDIEESAVLEYGDTVKIRVIDNDETYAMDEYFFSFWNSSQDAVNVLRIMVSGNGHHVTDEEISTTPPAVRPSQDVSTLGGVARGHDPQDVLSPTVREGVRSTLSPISPSSREPSLPRPSGETLRSSFDRSRRSLDVGRQTRLSSSEVRRSFSSGRSKSVSKDRRRGKSPLSPVLHDSSESATNSLDPETDSSAAIQSIGDTNASASQILSGSAVFNRPTIVRHTTAQSDLSVDRSLRNSQDTARSSDVRKPLPQPLARPQGQQGVGKRQTGAEGLHPPGLDEYNEAPQTGLQRSGSSSAIQDWMRAGSVPLQKASGIAGFLRNRSKRMSNLLATESMGYYEKVSGMWAGGRKHYGTAEGLAADDEIQETEDDEDAEKHEQRFRDHFAMPSSERLRATFFGYLHRVLPLYGKIYISDRHFCFRSFLPGTRTKLILPFKDIENVHKENGFRFGYSALVLVIRGHEELLFDFRESGSRDDCAITLLESLEISHYAQGPNVLSETEIEDAKAAKVEHETLQEARQKAEAEIQLQTPRDLQENAVERPVIFDDTEASIVRFKPDTSLRITCLTIGTRGDVQPYIAFCKGLIKEGHKPRIATHVEFEPWIRKHGIDFAPVEGDPAELMRVCVENGMFTYSFIRETHGKFRGWLDGLCSSAWRACQESDLLIESPSAMVGIHIAEALQIPYFRAFAMPWTRTRTYPHAFGIPEHKRGGAFNYYTYVVFENLFWKLTAGQINRWRRKELGLRSTTLDQLQPNKVPFMYFVSPHVVPRPIDYSDWIDITGYWFLDEATGWQPSAELVSFIETARRDGKKLVYVGFGSIIVEDAAAMTRTVVDAVLKADVRCILSRGWSDRLSKAGTSGDETPLPPEVFRIDQAPHDWLFTKVDAATHHGGAGTTGASLRAGIPTIIKPFFGDQFFFGSRVEDLGVGVYLRKLNTTVLARALWEATHSERMIARARVMGDQIRSVSIPRANLCPRKHSANKVLQEDGVGRAIQTLYRTLEYAKTLIKKRDGISNEADETIEESWTFIGDDSDPELFRRMSEFNPGEHLLSHGQVRGSGMALGSMVLKNNGKRRTSATVA

SEQ ID NO: 7916 - protein, 1413 aa, Macrophomina phaseolina
MASEYNIRDRSARIRPRPNRRPRQSFEIPERLRHGEDEDEDVTAPKSNDPRYTHRSVFDLITHAGSVANLRSRFTHDELSESEEEEDEHAAVARSPDPPAAQDSKQPEDPQTKHRRSLSNRKIFRHLHKLQIKPSKDRRGPPADESMSSSQILTPKPPQTEREHEKVDSQSMSGQIRAKAGMEASAFGSDLRTAHEAFGVGDPSIKDEGNLSQRLMEIFAFEEEEKVVADYPCWLLQTVLLQGYLYITEQHICFYAYLPKKTKEITKSGYLSKRGRTRWNRSWFILKGDVLAYYSDPTDLYFPRARINLRYAISANVTEPKDKTRDATDFTVTTNQRTYVFRADSAASAKEWVKLLQKVIFKSHNDGDSVKISIPLENIMEIEDNPVLDYAETIKIGVVDNDDSYAVDEYFFSFFGFGEEALNLMKRLWDGCRQQHLDLETERPTTPALNSRLATSASVQPGKSISPVRSTIFQTAAGTLSPTSPSFRRQSHSQVSGESTRSSFDRSRRSSDRGRSSSDRRRRSLSRGQNRHSLGPSQSERSGFSPVSSQVRDSSESAYFSMDPDGASSAAIQSINETDASASQILSRSDVFHRPAAELTDSEANPRASQDTARSAKLYPYPRTEQTVSTRSRTPIQSSKELGNDSELRDDKMQASASAYYSGIVSAGVLPFTKASGLVGSLRKNTMALGSRLTTDTMSVYDKVSGMWAGGRRHYAEDGHLIDEDAREMVDEGDAITHNERFRQHFALPETERLRATFFCNLWRVLPQYGKIYVSDRYFCFRSLLPGTRTKLVLPLRDIENVVKEKSFRLTHHALVIIVRGHEELFFDFSRTDVRDDCAVTMHQKLEQVRYLHSSGILNEENILQAEEAKAENDLLQHARSPEKQPAIPPHIGELDQSGAAVIFDDPQASMVDFTPRESMNITCLTIGSRGDVQPYIALCKRLIKEGHKAKIVSHEEFGDWVLSHGIDFAPVAGNPAELMQLCVETGMFTPTFLARAHSTFRGWLGELLETAWNACQGTELLIESPSTMAGVHIAEALEIPYFRAFTMPWTRTRAYPHAFAVREKKMGGTYNFFTYVLFEEVFWKATANQINTWRKKSLKLPPTNLKKLQINKIPFMYNFSPTVVAPPLDFSDWVRVTGYWFLDESQKYTPPTDLTEFIERARRDGKKLVYVGFGSIVVEDPKAMEKSIIEAVLKADVRCIMSKGWSDRLDKEEKTKESKLKDERPKVPPEVHQIASAPHDWLFRQIDAAAHHGGAGTTGASLRAGIPTIIKPFFGDQFFFASRVEDLGVGIHVKKLNVSAFSRALWTATHDDRMITKARMLGEKIRKEDGVGEAVKTIYRDLEYARSLIKWRNRPLSEDDLGEDAEEEWTFVDDDSDPELRRNPEQDQAVLQIKAQLQQIRQEEREEQAKDA

SEQ ID NO: 7917 - protein, 404 aa, Stenotrophomonas sp.
MRLLALTYGTEGDTRPLAMLCHGLIGAGHAVTLLADGGTLGSAQALDVPHAALEGDIHDEVVALVSRGNGVAAASSGLARMALQHVSGWMRQADAAAEGCDAMLTGGLAAFVGMSVGERRGMPVIGTGMIPLTPTRAFRSPFLPPGRSPGWLNRASYGLVNGLIWRQFRRPINAARQQLGQSPRRALWSGLPMLYGISPQLLPPPADWPADHIVCGQWRLPDAPWTPPVDLQAFLDAGPLPVYLGFGSMTGFDRERVLPALLQALAPRRVLLFPGWAGLPTGALPADVFVLGPTPHEALFPHCALAIHHGGSGTTHSACRAGIPSLVMPFAADQFFWADRLHRLGVAPAPLSPKRLDAATLAAAITIAETDATRARAAALGAAMSHEDGVARGVAMIERWLRPV

SEQ ID NO: 7918 - protein, 420 aa, Ktedonobacter racemifer
MRIVIMTSGTRGDVQPYIALGLGLHRAGYHVCVLTHDIFKPMVMQYGLEFAPLTGNPREMVEKVSTQSSPGSEENALRFTRSLAEVSKSNQVALAKDAQHTLTGAHLLLYSPLCFAGSYAAEALDIPAIFAPLQPVLPTRAFPYPMSFSRSLGGIGNRLTHTFVNVSIWQMMRSVMQPIRRDLGLKPLPASGSISWLYRHRQPIMPGYSSLVVPRPADWPDWVQVAGYWFLDAPQNWQPPASLLDFLAAGEPPVYIGFGSMVNRKAEETTYLIVKALERSKQRGIIATGWGGLSNADLPDTIFKLDEAPHDWLFPRMAAVIHHAGAGTTAAGLRAGVPSILLPFLADQPFWTERVRLLGVSPQPIPRNSLTAEKLAQAIMTTISDQAMRTRAAELGRHIRAEDGVGKAVQVVQKVLASHI

SEQ ID NO: 7919 - protein, 1404 aa, Tieghemostelium lacteum
MASIDTSQILRQISLSDSLSSVSKLYDEQHSNHSLSTLEEEDLKSSSDNSTMLNTNNSLIESLHGSRHHLHSSGGNIIIKSNSNINNNNNNNSNNNSNVETTNFDPNYHPPNVYIFNSEILGDFQSTLTDNENVQENQRIKDQIQRELLENLDIFENHQDIGEVCAFCECSLLYNHLNIANLVITSNYLLFLPQQQVQKGFTLESYLNKKGDYFWKKYWFVLSHDSISWYKNSVLKETHYPSGTILLMKIVSIEKISQDESGRPFTLQIMTNNQSYLLQSDSEVQLDQWYQEITRVQKNLTVLVPLSDIVAIQMETDAALFFDSLCITIKRGENCLVTPTSHSNEIFQLLVRLWNLNRGLKNNEPERNLVQNEFQQRFKLSHPVEIIANTQCLLYKDIELSFEGSLYASSDGLYFSSEKNIIIIPIQDLTAIVMDLKSETPETIIIYTDQNEQIYFDIFDDSEKFYDSIVIEYQQNHSNIFFNKYGESPPKPINTSTGITKKESRFSKLISPLPLPSLPSLPSLPSIPLFRSKSSSSISSSYGGSELSNSTSTFSANSTSTSLSSTFHSLFPLLPLDEPAQLSQNCTLYFFTLDSKVEGTVYITKSYIAFAPKETENPKYKKALIPFEDIVNIHKERIAMIFANHCVKIMTLDSKWVFGKLDNFIGFYNACQDTWRSQPNISGSEGIFTPLEAVRIKEKFGLPPDENLITWYNCTNLKGAQLKYGFLYITSHYICFRSKLGFQKRNIVIPFNVVTEIKKYSVLIPHGIKITTNNQVEFQFASLIHRRQVYHLLHDMWKKNKRQSISKPTTPLSTTPPMLSTQSFPLVSQTVKPSIPPLSISNLPQNGQSPTTPLSPPPIHSTMNSPPTSLITSPKAPHDHHHHHHHHHHIKFTGPMKITILTIGSRGDIQPFIALALGLKEQGHIITLASHEAYRSLISNDYGLTFAPLGGDPKDLMDLCVRNGIFTPKFIKEALSRFRSFIDELLKTCWEASKGAEALIATPGCFAGPHIAEALQIPFFSAFTMPFTRTRMYPNPFAPFASRQMGGVFNLATHVMMEKILWQPISGQINQWRTEQLHVPSWNSSISITETYRIPFLYCFSKFLVPKPPDWPSEVCITGYWLLKQHQNQQPHQDLIDFIDRGEPPMYIGFGSIVISDPDSLSSLLIDAIKVTGKRAIISQGWGGLKLTDKEPNDNIFLLDKPVDHSWLFEKMSLVVHHGGAGTTAAGIYANKPTIIVPFFGDQFFWGERIKACGIGTSIPFSTLTVKILSSTILSLLSDNSIKSLVSQISENMKKEDGVKEAIQSFFRYLPVSYIPPRPIPFSQASHCHLCKQSFSLLKDLLSHKLHCHNCGKVFDEACCSKKIPIRKYRMVQPVRVCDTCYPLLLTEENQHHINSNNSTTPTN

SEQ ID NO: 7920 - protein, 1451 aa, Colletotrichum fructicola
MPPPVPAGAQSISFGEEDVKKRVVKKLQKKRHEPQTPTMELPERLKEGDDAAEEDLIPAQGPPMFMNMNQSIFGLIAAAGSRVDFHDRFESSDEESGDDDDRHHTQDGGNDHGLFLHRKQRRRNDEPDVAKTTVLKKDSSSKSEKHKRKISGHKLLRSLPALPRLPRHKSKKESPKLEPPSEEASDASEASPSQEQADDTRDDEDGPRLAPVMSRMLEAKAEMSMRPSFDVERRSSDQLTYSDSADSSGTALARRLQDIFEFDHPEAVIEEYPCWLLQSVLLQGYMYITAKHICFYAYLPKKAHEVVKSGYLSKSGKRNPKYNRYWFRLKGDVLAYYKDPSNLYFPHGQIDLRYGISASVTDKKDGLNFTVVTHHRTYYFRADSAPSAKEWVKSLQRVIFRSHNEGDSVKISLPIENVIDIEDTQMLEFADTCKIRVIDNDETYAIDEYFFSFFSFGKDAISVLKILIEDASSNAKDAARLKAQQEEERQLPAPSARSSMSGSRRAIAPPKLKTTKLPEAVRATLSPLSTHSPSALSPRASMDASRTSFDAFRGFRRRSLDLSTIIRDSSPRRSFSGNRRSMSRNRLDENRRAPHKQGSTDSYVQSSMEDPSFSGMVASSNEDPSASQILRGSDVFQNPTMRRSASASRTELDKQQRREHKSPPALAAYSGQHAATTGSIQDGDKPPATPTLQSITKMGAFPLQRVGAFAQYLNSTSGKLGSMLATESMGYVEKVSGMWRGGRKHYDAPPEIKTDDEDLYEDAEGKIQTSMDRFRAHFALPETEKLQATYFGYILRVLPLYGKIYISDKSFCFRSLLPGTRTKLILPLKDIENVDKEKGFRFGYSGLVVVIRGHEEVFFEFGQAEIRDDCAVTLLQSLETTRYLRETGDLDLDEKEDEENAMAERDALKEARQVEEYNDHELRMPKQSSNISDAPTILFDDPKASFLNFKPPHALKITCLTIGSRGDVQPYIALCKGLLAEGHKPRIATHAEFQGWIESHGIEFAKVDGDPGELMRLCIENGTFTWAFLREANSMFRGWLDELLVSAWEACQGSDLLIESPSAMAGIHIAEKLSIPYFRAFTMPWTRTRAYPHAFVMPEYKMGGAYNYMTYVMFDNIFWKATAHQVNRWRNNTLKLPNTNLEKMQPNKVPFLYNFSEYVVAPPLDFSDWIRVTGYWFLDEGSDWKPPQELTDFIAKARADEKKLVYVGFGSIIVNDTAKMTQEVIDAVLKADVRCILSKGWSDRIKQGDDTGPVKEEPVMPPEIHVIKSAPHDWLFSQIDAAAHHGGSGTTGASLRAGIPTIIRPFFGDQFFFGSRVEDIGVGICLKKWGAISFARALWEATHNDRMIVKARVLGEQIRSENGVETAIQCIYRDMEYAKSLIKRKAGKNAHVEPDDDEESAEESWTFIGKDEPDPDMTTKKLSDMGALPGASDSKPLGTRALKSPSAQPVA

SEQ ID NO: 7921 - protein, 1709 aa, Aspergillus rambellii
MAPKSNKSAKIVHESASDSESSSSAESTRQVEESSESSSESENESATSSGKHLQSSTNGQKGPKSSQAESSRPSRPYKAPFGFKSAKNQPLPAPSTSALLSDLRGKQVFHITAPSFLPLSKVKEVSLAQALQGAPVLKHDGVKYGLPADSQTQSGVSGQTLFLYDTKTATYYRTAADVPTYHIQEMVDLPGGAEYDEMAIKAVKALEKPPRKQPRHLKMRFRPVGSGNAPPETIGSSSEESDAEEPKFIVPIGLEKEKERKRKHQQTEGDGSQPAAEPRKKSKKVSGDLDESGAKEKSKRSSKDRDGKKRKKEKSDDTKRRVDRRLSASRQSISSSRLFSSAFPERLQDDYDAQVDFTAPPGGAKPRDGIQYMQQSIFSLIAAVGSKSDFHTRFDDSSDSEGETDTKPQKTTGRAPQLDTASSQTDGSIAVPSIPGARSASENRGRRHRRSISDHKLFKPFKSTPKPESKQQQDITAPESSMGEELSRASTPRRTRSTTPRAAPILSRMVEAQARLDASSPTALCESPLDGQNDKIPQLSSASPLSLRLMEMFGFEEPEKVVVEYACSLLQSLLLQGYMYVTEGHICFYAYLPRKSTVAIKSGSIHKRGRKNPKYNRYWFTLKGDVFSYYADPSNLYFPSGQIDLRYGISASITESKEKGRDSRDFQVTTDHRTYYFRADSSTSAKEWVKALQKVIFRTHNEGESIKVSFPIENIIDIEESPMVDFAETFKIRVVESEETYAIDEYYFTFFKSGRDAFNLVKSLISDISTKSSPQTLSPQPDGPSRSKRNRRSQGRWSLASTSQLRGIAITDSRRRSVSTSFVASKQDAANTPPNMKQQDSSSSYINSLDQTTESSAILQSMTDTTESASQILNRSDVFQSPTIHTWQQRSLGVDQAGRRHSDETARSITAHGLDGLGLSGERAEIQYAISDSEQDSRDVSRLSATPALGDLVRAGVYPLQRAAGFAEYLRSRSRQMSTLLASESMGYIEKVSGMWAGGRRHYGETAGISPDGRAFYPETKEDSCRDEERFRAHFALPSTEKLQAAYFAYLHRMIPLYGKIYISQNKLCFRSLLPGTRTKMILPLNDVENVEKEKGFRFGYHGLVIIIRGHEELFFEFNAADARDDCAVTLHQHLESARFLVESGSLAPQEKDESEAAKIEHRMLQEARVDASSEQEMRANITESSELHSIFDDPRASIINFKPTESLNITCLTIGSRGDVQPYIALCKGLLADGHKPKIATHAEFEPWVRKHGIDFAPVGGDPAELMRLCVENGMFTYSFLKEATSKFRGWIDDLLSSAWISCQGSDLLIESPSAMAGIHIAEALRIPYFRGFTMPWSRTRAYPHAFAVPEHKMGGAYNYITYVMFDNVFWKAIASQVNRWRMNELGLKATNLDKMQPNKVPFLYNYSPSVVPPPLDYPDWIRITGYWVLNEGSDWTPPTDLTEFIRRARKDGKKVVYVGFGSIVVSDPSALTRTVIESVLKADVRCILSKGWSARLGDPTSAKVEVPLPPEIYQIQAVPHDWLFSQIDAVAHHGGAGTTGASLRAGLPTIIKPFFGDQFFFGTRVEDLGVGICMKKLNVSVFSRALWEVTHSERMIVRARELGARIRSEDGVATAIQAIYRDLEYAKTLARQRSILSATPFSPTPSAKTGDEQDADDDSADIEDWTIVGDDADFDISKRVRDRAVSDAENLPERLFSDIPNLRGLGR

SEQ ID NO: 7922 - protein, 428 aa, Devosia sp.
MVKRIAIATIGTQGDVQPYLALAVSLKERGYSVVLGATAEFEPMARNYDIEFASLGSSIQSFLQTSRFDKAMSQNMLLNAPALLRQGQRIVDTAARLAWNMAQGADAIILNMNTSFGVDIAEALRIPAIMVALQPLNSTSEFPLCIYYSPTFGPTFNKLSYTAMTVQQIYYNLPRNKLRRELMGLESRKKGGFFRNTDGTPLTTLYAYSSLVSPRPRDWPKNAIVTGYWQLRDRSDWQPSPEFKKFLAAGEAPVYIGFGSMPFGAERNTQILKDAVKAWGGRAVVARGWGGINPADLPENIFAFEKAPHDKLFQYVSAVVHHGGAGTTSAGLTLGKPTFVVPQTVDQPYWGRRVYELGCGPKPVRLRKLTPETLATALQDLTTNASYRSHAQALGEKLQAEKGTDNAIKVIERVMAHYVPREESRKRA

SEQ ID NO: 7923 - protein, 1466 aa, Marssonina brunnea
MAPEGLSKKRVARKLTKKRKEGRQVTVEIPERFRDGDDADEDCTALHGRNAYMNQSVFGMIAAAGSQVDFNARFDGGSSDDDDEPAGGPEELRVDSKTRRGKLPAKGEENHRTRFSENKLLRSLSGLGSRSKSREPNNGAGSGLPSIDPSSEAITLKSPSKHGHPRDTMVMSRMLEAKAELSLRPSFDLPRPKPGHLREGAVAEEPASSTLAKQLMDIFEFDAAEDVIEGTRLNGSKSFPISEGTPGHKKLTCVEYQCWLLKSVLLQGYMYITTKHICFYAYLPKKSNEVVKSGYLSKSGKRNPKYNRYWFRLKDDVLSYYSDPSDLYFPCGNIDLRYGISATVADKEKGKDATHFTVVTHQRNFNFKADSIPSAKEWVKSLQKIIFRSHNEGDSVKISLPIENIIDIEDSQIIDFADTCKIRVIDNDETYAIDEYFFSFFSFGKEALNVLQKLVEDTTAQQIPEDVLVSPTQIDSTRSSRSRSIGYTRRNSLQGPKEKRPIQPPPPTQTATPLLEESVKATLSPLGAVSPRASTEISRASSDPFRRSMDLKNFNRRSVDLGRINMDGAIRSVSANRRSSSRPGLDERRHTEKPGSSDSFVHSLEEPGSPAAVLSTSDDTQASASQILRGSDVFLSPTIRRSASATCRRDPDSNNDDSRSDSPSRVTANTAMEAPNPRHTAMTGSMAASNADQVEPSSSAPTLQTLVKAGAYPLQRAAGFAGYLNRHSKRMSTLLATESMGYVEKVSGMWKGGKKHYDEPQGLAPEDNMYDDDEDHTASYGDRFRDHFALPATEKLQASYFGYLHRVLPLYGKIYISDRSFCFRSLLPGTRTKLILPLKDVENVDKEKGFRFGYSGLVVVIRGHEELFFEFSQADTRDDCAITLLQNLESTRYLKESGLLTMEEKESAQTASDEHKSLQQARMEGFADHDVKMPKTAEEARTDGSPILFDDPRASILNFKPTESLRVTCLTIGSRGDVQPYIALCKGLMAEGHTTRIATHREFKDWIESHGIAFAPVEGDPAELMRICVENGMFTYSFLREASSKFRGWIDELLSSAWAGCQDSDLLIESPSAMGGIHIAEALGIPYFRAFSMPWTRTRAYPHAFAVPDHKMGGAYNYITYVMFDNVFWKAIAGQVNRWRRKELGLQATSLEKMQPNKVPFLYNFSPSVVVPPLDYSDWIRVTGYWFLDEGTGWTPPKELTDFIKKARHDGKKIVYVGFGSIVVQDSAAMTNTIVQSVLKADVRCILSKGWSDRLDKKAASAVEEPLPAEIHLIKSAPHDWLFKQIDAAAHHGGSGTTGASLRAGVPTIIKPFFGDQYFYGSRVQDLGVGIYLKKLNVSTFSRAIWEACNSQRMIVKAKVLGETIRSEHGVDAAIQSIYRDLEYAKSLIKRRDGKSSDESVEDPEESWTFIGDEKDPALVKRIHDWDSLAQSGWLAGNLGTGKSGTTTGSEGSGAFDNFEKDDVAA

SEQ ID NO: 7924 - protein, 626 aa, Polygala tenuifolia
MTDLLENRRSSSSSSSSSSGEVPSVGLDPPDVAGNGSHSKEIDNVRDTTTGGVPLNNGGISSSSGGSSRSLSKVNTLPADFSHNDESVSTSSPLKLERSKTERLRHNNLRPEEAAQIFDNKIPVQEKLKLLNRIATVKDDGTVEFEVPGDVEPEALSAGAKHVYNVADDEPLDATDLQYIPPLQIVMLIVGTRGDVQPFVAIGKRLQDYGHRVRLATHSNFKEFVLTAGLEFYPLGGDPKVLAGYMVKNKGFLPSGPSEIPIQRNQMKEIIYSLLPACKEPDMDSGVPFKADAIIANPPAYGHVHVAEALKVPIHIFFTMPWTPTSEFPHPLSRVKQPTGYRLSYQIVDSLIWLGIRDMINDLRKKKLKLRPVTYLSGSQGSENDVPHGYIWSPHLVPKPKDWGPKVDVVGFCFLDLASNYEPPEALVKWLEAGDQPIYIGFGSLPVEEPEKMTQIIVEALEKTGQRGIINKGWGGLGNLAEPKDSIYLLDNVPHDWLFLRCKAVVHHGGAGTTAAGLKAACPTTIVPFFGDQPFWGDRVHARGVGPEPIPVDDFSLPKLVEAIKFMLDPKVKERAVELAKAMENEDGVTGAVKAFFKQLPRKKNEPEPLPTAPTFFSVRKCFGCS

SEQ ID NO: 7925 - protein, 1448 aa, Paracoccidioides lutzii
MPPYDESRSKGGAGRLNTHSTSSNRLSLSHIPERLRIGDDEQEDMAAPPSDTAGRAGMLTHMHQSVFSMIAAASSKSDFHTRFDEYSDADEDTDQPLKNRFLSNDSVDIRGGDSPSTNQLTQIAHGDKPSPSSKTLNERGRSIHRKRMSESQFLKSLSKLPGKSPTGKETTPEPDVTASNEPSAGEAVQIVASTEAPVQGLMREAQARFGESESPPNQTGISEKDRQRKESSLSSLLSARLMDIFGFDRPEKVISEYQCWLLQSVLLQGYMYITERHISFYAYLPKKSHTIVKSGYLSKRGRQNPKYSRYWFTLKGDVLSYYLDPSNLYFPSGQVDLRNGISASLTEHKGKDKDVKDFTITTDTRIYRFRADSATNAREWVKTLQKVIFRSHNEGDSVKISLPIENVIDIEENPVIDFADTFKIRVFESGESCAVDEYFFSFFECGKEAIEVLKKLVNQTPEQQIQHNAFAPDYGRAPRPRSQSVGAVSPPCGTTLHPESVRATLRPWSPLRDRSRSPKISGLRGLMQGHINEPNVAGLGQRRRSESTGRVNVGDHPPERSPEGKLQSSSDSFVQSLEHATEVSAILQSACGTAESASQILNRSDVFQSPTINMLRPSPSEPGDEPRRHSEDTTRFVPSGAEVEVFNQPPTRTQITESLMRSGPVEPQDGGGDSEHDLQHRSAARSASSPTLQELMKVGSYPLQRAAGFLKSRSKRMSNILATESMGYFEKVSGMWIGGRKHYGEGQAVLSDDRMVDPEDEEQGCGHGQRFRAHFALPPSEKLVATYFAYLHRVLPLYGKLYISNRKMCFRSLLPGTRTKMILPLKDIENVEKEKGFRFGYHGLVVIISGHEELFFEFNTADGRDDCAVTLHQNLESVRYLVESGLFAQQEKEEAEAAMAEHQMLQEARLGGLDEQQGSQTLSSSVPLSPATSPILFDDPRVSMVNFKPHESLRITCLTIGSRGDVQPYIALCKGLIAEGHRPKIATHKEFEPWIRHHGIEFAPVEGDPAELMRICVENGMFTYSFLKEASSKFRGWIDDLLSSAWKSCQNSDILIESPSAMAGIHIAEALRIPYFRAFTMPWTRTRAYPHAFAVPEHKMGGAYNYITYVMFDNVFWKAIAGQVNRWRKRELGLRGTNLDKMQPNKVPFLYNFSPSVVPPPLDYSDWIRVTGYWFLDEGSSWTPPTELTNFIEQAQADKKKIVYIGFGSIVVSDPAALTKTIVDSVLRADVRCILSKGWSDRLGDPSSGKVEIALPPEIHQIKAAPHDWLFSQIDAAAHHGGAGTTGASLRAGIPTIIKPFFGDQFFFGSRVEDLGRLNVSAFSRALWEATHSERIIVKAKALGEQIRKEDGVATAIQAIYRDLEYAKTLVRQRSHTLSASQAVALATSTLEETGIDIPDMGLDDDGHGSGSGSGDPDFYGAMEDSWTFVGDETDSDRAKRSGDREEL

SEQ ID NO: 7926 - protein, 1446 aa, Polyporus arcularius
MAQDGQPDTPPAATPTNAVSPPTSPSSASGEPVSDIKGGVVKRAMDKTVDKLGRGKSLLSQSQPSLPPPAHRRMFSLTRGKGKERQTAGEQPISRSQVLSSPPSSPPLSPRKHTRVSGATGEDDDPFITPSSPSLGPSHPESLVFRGFRSMHAGTQTIIQALQAVPWAEDLDNDDDYMNHDAVAPVMTESDGDERVSRLTSSIHAIYRPLARVRRGDPSASSYRATKAPALPTLSDTEDSPRPDESPVSDEDTEGDFEPHIGGNITDAGHSGRISPETILDLDNSIPDVPANAASDRRASTRSGSMATVRQNRRAQLAEKLQGVFELDNINEVVAEMPCWLLRSVLLQGYMYLTDTYICFFAHLPSREDQVLKSGSLFKKAQRTKRWIRHWFVLKNDVLSWYQSASDPYFPHGVVDLRYAISCEPAGEKDIRLRTTQKSIRLAADSVPSRDEWVKAIRRVMLKAQNMGDSIKIAIPYTAVVDVEKSSAMDFSETIEIKVQDKNTDLALDSYFFAYFQDLSLALEQIRDAVRSYRLIPSAQDPPIVVDTTAGRSLTRPHPVERVASSPQAEGPSKPPSAFRLTSFLRPLHETLPLSRSASAPGARDTNEEFTHIVKKADSSFVPATHSGSTSPSEGEPSGRPSPIPSSTSSLTTPTASHHTYPPSTSASMIDTHGSAPLSASAGSSGWSVGMPSMPSWLRVPSRSLFGTPIAPSRPRMEHAATTPPTLSLPTVSEVVSSRASSSSRPTTSTSISGDFGYYSILETPQTTVDSETVEKFRQAFAFDDKENLLGVFSGFLFRLLPMYGRLYVSDNYFCFKSSGPLTSRTRMMLPLKDILATEKQKSFRFGHHGLVVIVKGHEELFFEFVDEERRDGFIRVLQKQLEAVRGRTTSGDLKSPTSTDTRHEALILGEYGPRDVQNMSDSRASSTESAPAFMFTSQSSTFLSFKPERSLHFTFLTIGSRGDVQPYIALAKGLMADGHRVRIATHGEFKEWVESHGIEFGYVGGDPAELMRICVENGTFTVAFLKEGVQKFRGWIDDLLKTSWEACQGTDVLIESPSAMAGYHIAEALKIPYFRAFTMTWSRTRAYPHAFAVPEHKMGGNYNYMTYVLFDQVFWRGTAGQINRWRRNTLGLAGTSLDKMEPHKIPFLYNFSPTIVPPPLDWPEWIRVTGYWFLDAADVSSKKWEPPQDLLDFMDEARKANKKVVYIGFGSIVVPDPKTMTRCVIDAIVQSGVYAILSKGWSDRLVKNAPAQTEPEEPLPRQIYPISSVPHDWLFKQIDAACHHGGAGTTGASLRAGIPTIIKPFFGDQFFWADRVEALGIGSAVRKLTVDSLSQALHEATTNQKLIDRAKLVGEQIRLENGVATAMEAIYRDLEYARSLIKGAASRDMEHDEYFDAEHATIRDYQASSSPPEHPSPSWSASGAVSDWSVISDSDEPSHDSHSST

SEQ ID NO: 7927 - protein, 840 aa, Talaromyces islandicus
MAGEKRKDKEDQSGAAPEPPLHSNSYNPGTCDGDLDPPPSIDWDDPPVYELIGSGDRASTTVVAQDDGRVAISLLTAQSLSIPAPSQQKPYTIPNISNSRCPRLNIVIQIVGSRGDVQPFLALGRELQVAGHRVRIATHDVFREFVTKSGFEFFPIGGDSSSLMAYMVKNPGIIPKLETITSGEISKKRKMVYGMLEAFWRSCIQPDPETNIPFVAEVIIANPPSFAHVHCAQALGIPLHLVFTMPWSPTRAFPHPLANIERTDADLSTTNYLCYGLVELITWQGLSSVINGWRRKSLSLDPVTILTGASIAEALQIPFTYCWSPALVAKPQDWGNHIDVCGFFFREEPSYTPGDELDSFLRSGPPPVYIGFGSIVMDDAEKMTAILLAAVRACGVRAIISRGWSKLGSGQQDTNVLFLGDCPHEWLFKHVSCVVHHGGAGTTACGLLNGRPTTIVPFFGDQAFWGQMVAASRAGPSPIHHKSLNENNLAEAIRYCLTPEAIDAAAEISRKMKAENGVQAAARSFHSNLPVDAMRCDLLPDELAVWLYVRSKKKTPLKLSDKAAFILTENKRVEAKYFKLWVVPKKNPITMRIESAHVFNISYQPKPITIENQRWDPVTAGSSVLLGVLFKFTVGFSQVFTGPAKAFQSKEQGGGKKEAAVHFGKGFGKMVGVLPKATLVDFPLALTEGLHHLPRLYGEEVRNHGQVKDWKSGGVVAGKTFGYGFVDGLSGAVIKPYEGAKEGGWTGFGKGVGKGVMGLVTGPGAGMFGLFAYPFLGMYKSISTSSLSPTQKKILLARQVYGSYMAREREYSAQREGRGSDDATQDLVLEAFDRKTARID

SEQ ID NO: 7928 - protein, 765 aa, Aspergillus flavus
MDSHLYDEPPPSYDVAVSGDRMDASTLVRNDGRVDVTVVAKQAGLNDFLHSNLPTETRPLPDVPLSAITPLNIVIQIVGSRGDVQPFIALGTRLQKNGHRVRLATHGNFRDFVHKAGIEFYPIGGNPEELMSVSIFLTLDRDKFMVKNPGIIPKMSTIAGGEIGRKRQMIAEMLDGCWRSCVEPDPETKIPFVADAIIANPPSFAHIHCAQALGVPLHMMFTMPWSPTKEFPHPLANVKGSGTDASLRNYMSYSMVELLTWSGLADIINRWRVKALNLEELSPRTAAGLMEAMQIPHTYCWSPALIPKPLDWPSHIDVCGFFFRNEPLYTSPEIQEFINRGSTPVYIGFGSIVMDDPAAMTAIIQGACQELGIRAIVSKGWSKLGQGCNDPNILFIDDCPHEWLFKHVAAVVHHGGAGTTACGLLNGCPTAIVPFFGEYLTMTSQPFWAKMVAAAGAGPSPIDHKVLTVKLLSEAIAFCLTRNAQQAAASIAAKMKSEDGVSNAAASFHRHIPWKDVKCDLLPSEAAAWLVDKKRGLKLSHKAMVILSQHKQIDMQHLKPYRAKEMRIEKIYTDPFSSTSAAVLNTMTDFTVGLGKLSTSPTKGMTQMTSSLVKGTLVDAPTALAEGLRNVPRLYGERPERPVPIEGWKSGMTHAGKSLYTGFADGLTGFVTKPYREAKTDGAAGFAKGFAKGSVELFSKPGAAMFGLMAYPAMGIYKSIKKGNLNPTERKIVEAQIELGDYMLQSFPASPAEIEMVLSRFNTLS

SEQ ID NO: 7929 - protein, 1945 aa, Pseudogymnoascus sp.
MVKKESEDSSATMAKMEPKDSKMSAFERKRLENIAANQAIMKDLSTTAKKIIPKAAPKPARSKTPSKREPPVKKEAARPTRTSSRIAGLEADGEGAKRKYEEEFQFAQDEAKAKKMRVAGDLNLSDIAVEGKKWTNDDNFLTSIMRGAKPYERTFDDSDVKTTTDKELKSLREKMSGLELYKTWEPNDIKITPERIYSMGFHPTHDKPLIFAGDKIGNLGLFDASQKGEVDDDGDQVEAPVITAFKLHARTITSLLFPPNHTELYSGSYDSSIRKLDLEKQIAVEVYAPPSMDDDEAISAIDMNSNDPNLIYFSRLDGAFGRHDMRTQKDTEIWYVSEKKVGGFSLHPLHPHLVATASLDRTLKIWDLRKSTGKDEARKPGLLGEHTSRLSVSHAAWSSSGHVATSSYDDTIKIHSYTKAKTWGVGYTITEEDMEPSAVIRHNNQTGRWVTILKAQWQQRPDDGIAKFAIGNMNRFVDIYTSKGEQVAQLGGDGISAVPAAAEFHPTRNWVAGGTASDVKKRVGRKLTKKRREDRRVTMEIPKRFEDGDDEDEDCTAPRGQNGLINQSVFGMIAAAGSQADFHARFDGQDSDDEEDEITEPEDVTRASEASSDLTTSKATTDDRISRHMFHRRKLSDNKILRSLSQLGIRNRTKHAQLSTASSDPVTPEKTKDTERDHTTWSPFKGPPIMSQMLEAKAAAVQRASFDSRRSDYIPGQADGADGRDGAEGSPSDLSIRLMEIFEFDSPELVIDEYPCWLMKSVLLQGYMYLTEKHICFYAYLPKKSNEIVKSGYLSKRGLKNPKYNRYWFSLQGDVLSYYTDPSDKYFPSGNIDLRYGISANVVDKEKTFFEVITNHRRYQFHADSIPSAKEWVKALQKIIFRSHNDGDSVKISLPIENVIDVEDSPVIEFAETCKIRVIDNDETYAIDEYFFSFFSFGKQALNVLRTLVSDSAAKQIPENMLAQHQGNSGSNSPKAGSSRPSLTISTRESKPVVNHGKATSTGLEESVKATLAPLMSSPLHVHSPRGSGDFSRASFDINQRSSSQTRASGRSMEVSRFNLDGNGRNGSPSNDRRSFSRNRLPEKRNSEKHDSSDSYVHSMEESSAAAQSASEDATGSASQILRGSEGFFQPTIHRSASASRRRDDAQLPGGPLLPQTPTAPHHAATMDIYERPKLTQAENVSTPSLQTLAKAGAYPLQRAAGFANYLNRHSKRMSTLLATESMGYVEKVSGMWKGGKKHYDEPLGQGLEDDTDDEGDHSDGAEHRFQSHFALPVGEKLHAAYFGYFHRVLPLYGKIYISNRSFCFRSLLPGSRTKLILPLKDIENVDKEKGFRFGYSGLVVVVKGHEELFFEFGQPDARDDCCVTLLQNLETIRYLKESGLLTQEEEESAAWAVAEHKALQEARQESRQHSHDLELPTTAEGASADTAPIMFDDPRASILNFKPTESLRITCLTIGSRGDVQPYIALCKGFIAEGHRPRIATHVEFKNWIEGHGIEFAPVGGDPAELMRICVENGMFTYSFLKEASTNFRGWIDDLLSSSWLACQNSDVLIESPSAMAGIHIAEALSIPYFRAFTMPWTRTRAYPHAFAVPEHKMGGAYNYITYVMFENVFWKAIAGQINRWRKKELSLPRTSLEKMQPNKVPFLYNFSPSVVVPPLDYSDWIRVTGYWFLDEGTDYKPPKEISDFIAKARADGKKLVYIGFGSIVVSDSAALTKTVVNSVLKADVRCILSKGWSDRLDKVGATEPEILPEEILQIKSAPHDWLFAHVDAVTHHGGSGTTGASLRAGRPTIIKPFFGDQFFYGSRVEDLGVGIYLRKLNVSVFARALWEATHSERMISKANLLGEQIRSENGVDTAIQCIYRDMEYANSLIKRKTGSHHEGLAEDIEESWTFIGDDNDPELMSRIHAWDPRVVLAQSREADVTEPPVPTSRSETPLPSEHESGSK

SEQ ID NO: 7930 - protein, 1602 aa, Candida parapsilosis
MTLRDKLSSITHSIDDTLSLRGDSPEKDEHHDKHHTDDASLKKTRETATRRDSGFGEGKSKNEMTTSQDESGNGPKHEKRKAENHTCGRAKESTEESHTNSELKQSAPRRSDTQESEEDCAMPSGDMNANFFSTLMNNTTLSSGFGSLRNLKTSAMENFLKGKKDGIDEDNHRNHHHHHQQQQHQHSKHLHPGKVSSSTTSGASSPIHSTPNSRPASPQPVHNPHHSNVNADESSHKTLPHDITSGENSSTDESSDEEEEFEASRLAEPGVPRKEADETFLARAENPPSATPMDSEVTSYSTLNNDASAQEEPLTDGDTLASFRKNTIILEDGGNQGLTNDQIEHLTPFQKSVIEKLDPHHIKEGVLVKVRNRQDEPGDGGKLSATRKLLRYKIAERLTQTFELSPDDIFRGNFNAWLVKDVILQGHIYLTEKALVYFAFLPRRYSIEESADPRNFDDSATVVHSGALGMKTAKYGDSKFQTVLTHRYWAILRTETLTIYSSFTDLYFPLKVIDLRTCLYAEIATKEKIKDVTSPISRGSQTPSAIRSGYTSGQITPPIISETASDLDSMLSQEGFEATEDNVEARSSSVWINLVAKKKTYRFQCDNLHSARQWCNTLTKSIFQLRNATTTGDVFVKIPIANIVDFRRRTLFEEEDGIIDEAENDIPLSFSIKYVTNNPQEKKKRDKIKDKFKHAEEEIYLLVPKSGLDFFKTFEDVMQKQATRVQEGHKMFGSKKPELEKTFTSLSPSVNRVVQNLINSNLPEESRENTSAFKKFGISFGLPFKDEITPTFNLPEVELEQDHLSFPRAMSENVFKDLDITFESTFKNLKDASDRWDSDYQKTINAIDNLPIPSLRLDQKDTRKRGFGKNIKLFSNMTAKFSASPIHYTIEDKYYVSESKEREEALQHFQEHFSLYNSRLVASYYCHLIRTVPVYGKLYVAEHDICFRSLLPGVSTKMILPLTNIDGIEPVSGKIYAGTKLTLQGAEELNLEFAFAKSRDDFTNVAWELLDKLHANESFHPKPHEWGPNHNLELSKTRMEYTDSERRRLDDRDNHRDLEIAESKVSLARIKMFEDRLTSASGLDIPIVLEDSPFFKTEMKPSTSYNITLLTIGSRGDVQPYIALALGLQKEGHTVTIATHGEFKDWIEKDHHIKFKEIAGNPSELMSFMVGHSTLSVTFLKDAQAKFKDWISKLLTTSWQACQGADLLIESPSAMAGIHIAEALVIPYFRAFTMPWTRTRAYPQAFLVPDQKRGGSYNYMTHVLFDNVFWKGISAQVNKWRVRELDLPKTNLYRMSQTKVPFLYNVSPCVLPPANDFPDWVKVTGYWFLDEGGKDYKPKKDLVNFIDQAAKDEKKIVYIGFGSIVVKDAASLTRAVVEAVLEADVRCILNKGWSDRGSHKDKNQMEVELPPEVFNAGSVPHDWLLPKVDAAVHHGGSGTTGAALKAGCPSIIKPFFGDQFFYARRIEDMGAGLALKKLTAKSLAKALVTVTEDLKIIEKTKSVSNQINHEYGVLTAIEAIYSDMEYARSLIWAKELHNANYKRHHPDFKAQSGLQTAEVSEDESESEYDSDSTSDEEDADGDLTEREDDERKKHESNLKGKR

SEQ ID NO: 7931 - protein, 409 aa, Streptomyces sp.
MTAGSRGDVAPYTGLGHGLSRAGHEVTLVTHARFEPLAARAGLRFHPLPTDPRAELESSRGRRLHRSATGVGKMVRVVAMARALVGLMTDDLVAAARTSDALLLAASLGPLGHTIAEGLSLPSLGVHLQPLSPTREFAPPMLGVGSWGPVGNRVAGMGVSLAVEQVFAAALPPLRARLGLPRAHTTAGLRARERQGWPVLHGFSPLVVARPRDWRAGLDVAGYWWPYDGEDRLPPRLEEFVDAGPPPVFVGLGSATVPDPRRLGADIVRALRTAGLRGVIQRGWAGLEASGDDMLTIGEVPHSLLFPRMAAVVHHAGAGTTAAGLRAGVPAVPVPIQFDEGFWAARLVGLGVAPRTVPLRRLTADALAAALVRATRDPGYGERARALGARIRSEDGITPVLDAVNRLAD

SEQ ID NO: 7932 - protein, 1410 aa, Rhizoctonia solani
MSDSHDSSDESDGGKGILKRTVEKIGRNTSISRSKRQGDTDSRTHRRLFSLNRHKGKDKAADEVAGILGGHAAGGISSDADASPQKSKSSPRVSRMAATTSDLRRNKNQTSNSRPSMSIMGLGKQDEFGIGSMRMGTQALIQALQAMPWDEDRDEDPPESAAKRGKTRRESASPDSSDEEEQAKADFVLASSIHTIHRPVAHSRLATPAFHQSVHYGLNPPLEAPEDYFSNPLSADEDDGLRDFDDAATPEGIPNPFKDPPRMRLQLPEDKQSKLEGKKRMPPPMRTASMATVRMKRRVKLADKLKEVFGIPEIKEVVAEMPCWLLRSVLLQGYMYLTNTHLCFFAHMPAREDQVLKSGTMSKKAQRTKRWNKHWFVLKNDVLSWYQSSADPYFPHGNIDLRYAISCDAHREKGIRLRTNQKTITLQADSVPSRDEWVKAIRKVSLSFSRRRTMGESVKIAIPYSVIDGVEKSSSMDFSETIEVKVIDKEENYALDSYFFAYFRDLPAALAQIQQVLSDYQDTAPPGEAHLTDTTQAYRGPLQQQHLDRTASAPPSSHQTDSSSGFRISSLLGLRPFSSTGGEEPHKASSISTVHTGEGALMQHDPASPESGAPGYNWLRGKRLFSTPSSIDSGSRFTEGNVSEVISSPRLDQSEPSVSSDGNNLGFSILEASEDGKAADAGMEEKFRSTFALDDKEALLGCIPGSLFRVLPVFGRLYVSTNYFCFRSSQPLTRTRMMIPIRDILSTEKQKPFRFGQHGLVVVIKGHEELFFEFGSIERRDACCNLLEMQKEVLQKQALSPISPNHTQGKRDALILEELEPSVLISDDDPRPAPEVLASDAPVMFASTSSTLLTFKPDRPMHFTCLTIGSRGDVQPYIALCKGLQADGHKVRIATHKEFQSWIEGHGIEFALVGGDPAELMRICVENGMFTVSFLREGVQKGTDVLIESPSAMAGIHIAEALKIPYFRAFTMPWTRTRAYPHAFAVPERKMGGSYNYMTYVMFDQVFWRGISGQVNRWRRQTLRLPSTNLDKLEQHKVPFLYNFSPTVVPPPLDWYEWIRITGYWFLDDPDDSGSKKWTPPPDLVTFMETARRDGKKIVYIGFGSIVVSDPDAMTQCIVEAIKLSGVYAILSKGWSDRLSTKKSNTEPPPTYPPQIYPISSVPHDWLFERIDAACHHGGAGTTGASLRAGIPTIIKPFFGDQFFWSDRVEALGIGSSVRKLTVENLTAALRAATTDVKQIERAKLVGQSIRSENGVRTAIEAIYRDLGYATELFRKDTHVDLDADESEDDETIQESKTPAARRSSLDPVMFGSDSSCGSGQGNGEDSSWSVISDHPPPERVRVESTGFDKRSGESGDSSVSESRTPNAGQTQTSGSRGLSNLPAIGLALLQDTLTAYSPSARGEVPNGKP

SEQ ID NO: 7933 - protein, 1412 aa, Elsinoe australis
MATRNTSQHRRASRQLSRRKRDPGMIKLPDRFKTDDDDEAQEEVDMERGGMPFMHQSVFGVIAAAQSKEDFKSILDEEVSEESGDESSGTVSEPKRPSYGSQVDPAGPSRPKQKKKLSDHKLLRSLPGLRSRHAKDKDERGRKASSPLSSPPMEENTFRDAPVMSQMLQARANAADSLESSNATLTNKASASTTSLRSSRKAPVALPEALKDIFQFDQSEEVISEYPCWYLANVLLQGYMYITQRHVCFYAYLQQKSNTTIKSGYLAKRGKTNPHYRRYWFTLKGTVFSYFTDPSTPYFPSGNIDLRYGISADLEKEKEKDRTKETTFFSVTTDKRTYHFKADSVPSAKEWVKQLQKVIFRSHNDGDSVKISLPIDNILDIEENPVIDFAETIKIRVIDNDETYAVDEYFFSFFSFGKDALNVLKIMTQDTMAAKALLEQTGKEASQPGSGVTSPKIDGEGRPSMNLTVPEIYENVRATIPVADGPRRSMDIIRSGRSSIDGGRRSIDRPRASFDRQQRSVSAASRVSFNKPQARAKSPMPGAFDHSPDSSVTADDSAPQSIMNESTDQSESDPSGSRILSGSGVFRDPTLAASASRRQPESPRLRPSGEFMRSVASSRSASNERRIEKSPLSPKTPSDDFTKPSSAQQIHKAASAPTAEPRQSGSYTESLGGLMRAGAYPIRQATDLAGMLRDQGRRMSSIPRGYYEKVYGMWAGGKRHYADADGLKSEDYVHDPDEESDTAQAEARFRDYFALPESEKLVASYFAHIMRVLPLYGKIYIGSTKLCFRSLLPGTRTKLIIPFKDILNVDKEKGFRFGYSGMVVVIRGHEEIFFEFNTAGLRDDCTVTILKSFDTMKQRVEHVTITEEEQAEAEQAAQENLRLQEARADGYADHDIMLPRDIDEIDHGAPTILFDDPQASLLDFKPSEPLAITCLTIGSRGDVQPYIALCKGLLAEGHKAKIATHAEFEPWIRKHGIDFAPVEGDPAELMRICVDNGMFTPSFIYEANAKMRGFLDTLLTTAWTACQGSDVLIESPSAMAGIHIAEALGIPYFRAFTMPWTRTRAYPHAFAVPNHKMGGAYNYMTYVLFDNLFWQSTAGQINRWRRKVLRLRPTTLDRLQPNKVPFLYNFSPSVVVPPLDFSDWIRVTGYWFLDEATSWVPPPPLLAFINKARSDGVPLVYIGFGSVVVSDSRALTKAIVKAVEKADVRCILSKGWSDRLDDAAKTVPEIPLPDCIMAISSAPHDWLFAQIDAAVHHGGAGTTGASLRAGVPTIIKPFFGDQFFFGARVHDLGVGVCIRKVSEQVLGKALWIATHDARMREKARVLGEQIRSEDGVGNAIKAVYRDLEYAKTLVKRRGRRVEEGQSEEEDLEVEAEGQSESWTFVEGDSGEEVGGKVGKGMGREAVGSPRAG

SEQ ID NO: 7934 - protein, 1457 aa, Exophiala aquamarina
MANNDTPPPKKATGRKLQKRNPKLGRLPSAHIPARLRLGDDAQEDVTAPNRGTNNPGQYMHQSVFSMIAAAGSRTDFNARFDESSDSEEEAIEEEQGDAVAAEPSAKATATVTPEGPKTSSDKKMKRLSGKLVQSLPRLSARSLTKKSKTSTQQPSPSPQSDSTSKSSRSNPRDAPVLSRLLTAEAEYQEDAEASAEIASSLEVPSTRSRGDSSPQTLLATRLMDIFGFAKPEKVVAEYPCWLLKSVLLQGYLYITKQHLCFYAYLPKKSHSVAKTGYLAKRGRTNSKYKRYWFSLKGDVLSYYSDPSSLYFPSGHIDLRYGIAAAVSAEKGKQSDARDFSITTDHRTYNFRCDTPQSAKEWVQSLQKTIFRSHNDGDSVKISLPLENIIDFEESPVVEFAETVKLRVIENDDSYAIDEYFFSFFSFGADALSVLRDLIVQAPGGRSPDDEQSLGSRGDYSSSPGRRPFPQRTTSEGAVSNPRVVTSPTLKEPVKATLMPFSLGEDGRMSPRMSGEFQRTNSPSRSSGDFGAEYGRASFDRGRRSGSTSRLDVSKTRRTGRSPLARNQDSEDSYVQSIDKETDSSTAPLSPTVEAQMSASQILTRSDVFHPPAINRMETLVSMSSDAGRKSSEVGTILSTSQADGSAPIPIGGKTEPGGRPSKDRRTAVQDESGDLDHDKKYSSSPTLQDLVKAGSYPLQRAGAFADYLKNRSVNMRKLLATESMTYLEKVSGMWTGGRKHYGENEGVIPDDRGIDPEDEEANVGHGDRFRSHFALPATEKLQATYFAFLHRVLPLYGKIYISNRKFCFRSLLPGTRTKLVLPLKDLENVDKEKGFRFGYHGLVLVIRGHEELFFEFNSAEHRDDCTITLLHSLESVRYMGESSIFTHHDEDDAEVAKEEHRLLQEARRNSSADHQLVLPDTAEAIYSHVERSAVLFEDPRASIINFKPAESLRITCLTIGSRGDVQPYIALCKGLLAEGHKPRIATHAEFGPWVMKHGIDFKPVDGDPAELMRICVENGMFTYSFLREASAKFRTWIDELLVSAWEACQDSDLLIESPSAMAGIHIAEALHIPYFRAFTMPWTRTRAYPHAFAVPEHKIGGAYNYYTYVMFDNVFWKAIAGQVNRWRKKELGLRSTNLDKMQPNKVPFLYNFSPHVVVPPLDYSDWVRVTGYWFLNEAQGWTPPPELTEFIKKARYDKKKLVYIGFGSIVVSDPAALTKTVVESVLKADVRCILSKGWSDRLGDPSAVKTEVPLPPDIHQIKSAPHDWLFTQIDAAVHHGGAGTTGASLRAGLPTVIKPFFGDQFFFGSRVEDLGVGICLKKVNVSVFSRALWEAVHSERMIVKAKLLGEHIRKEDGVHNAIRAIYRDLEYAKSLVKARVATQEALASAATDLDEGNEIEENWTFIGDESDPELQKRIQDWEAPSRGRGPRVSLDRAGLRAMQGVEPLRKGSIKRL

SEQ ID NO: 7935 - protein, 417 aa, Unknown
  Description of Unknown: Symbiobacterium thermophilum IAM 14863 sequence
MKFAILATGTRGDIQPFVALAQGFSAAGHEAVLAAPRAFESFVRSYGVDFFPMGSDFTALLESPEGKAALRENPIKTMQAVRQTVIPMMRRMLDDAWAAVQGADAIIYHPKALAGVHLAERLRVPCFIGAPVPVVVPTATFPAPAFVSRDLGGFLNRLTYAAVRSGTRPFRKMIDAWRREVLGLGPRREDEFTQGGQPVPVLHAFSRHVVPPPADWPPEAVVTGYWFARRVQVWHPPEALSAFLEAGPPPVYVGFGSVAGLDRDEGTRMALEALSQAGVRGILATGSGDGPRLLSPDVLAIPEAPHDWLFPRVAAVVHHGGAGTVAPGLAAGKPTLVCPATTDQPFWGRVVHQLGVGPAPIPRRQLTAERLAEAVRAATGDPEMQRRAAALGEAIRAEDGVAQAVAEILRRVGALAG

SEQ ID NO: 7936 - protein, 421 aa, Herpetosiphon aurantiacus
MRILIIAFGTRGDVQPMVALGLALQERGHSITLLVSSNFKSWVEEFGLQVATARVDIQQMMLSDHGNDWVKHGANPIKQRNAMRRLLKQHALTMVEDAWQVAQNCDVLISSFTSDVFAVTLAEVLNVVHISTPLQPAMLATRCGPASAAAILPNHESIINYWFGRWVLEPFMWQVGGDFINQFRQQQLKLPAQSVREYAQRLRQTTIIQGYSPAIIPHPSDWPANIQTVGYWMLPPDEAWQMPPELEQFLADGPTPIYIGFGSMTGANPDAFTELLLKAVAHSGQRAIIQTGWAGLGQIELPKTVFRIGSAPHERLFRHVKAAVHHGGAGTTAASLAAGLPTVIVPHLGDQLRWGQRVFDLGLGPKAIPRNKLTVDRLAWAISQAANTPSMQHNAQAMAKTLQAEQGISRAVEIIEQRIQA

SEQ ID NO: 7937 - protein, 1480 aa, Clavispora lusitaniae
MQDNFKGTKLSALERRIMDSLKIEERHEQLSNVLPLYRRVTSALIPPLQYSIGFLHPHEDDSKEEGETEGEENKGEKKNPENLSSDEIDVACPLEEESASNSFLNALTTAVFYASAEPLKSYRKGPSKEKEEQVYSVADETVQEVTVENLKEEANEQLQDSEDEPKFGSVIDEKDIHDASSVSGSDISSDTSTLSEVRRVLTGSGKVPDIDQMTPWEKSVFQKVNLLLNHDQGIFSYSTEEKREEPDFEALPWYIANRLKKTFGLSDNDQFHGRFEAWLVRDVLLSGYIYLTSSSLCYYSLLPGALSEEKDTKDDRKVEEGALGFKLGHYGDSYYNSVHKHLFWAVLTSSNLCLYTSSSEMFFPVKVVDLKTASYCEVLTEPVGTLGQKSEQHDTKLSRSLSDSSLSQLESDASSIADSSDENAESLQGGVWFRIVCDKKSYKFHTRNIFTARHWCNAITKQIFQLKNSNVHREVVLKIPFDKILEFRKNFVLAEADEDIVLDNDTPVTFTAKYNTVIRKKGIDGEQQKNAIPQSGNVSYDFVHFLLFNQGKDVWDAIEKLLADSQKLDVVTESDESTQGYENQGLENEPSIISTLEADLESSMSIIDKIARVNEDVYQLRERERYKFKNGVEEFAKLGKESPEKNNVVSKILSKPMKRKGSSKIFCNSGSSGSTESSLNRILGEDGSGTDFLTDLVMDGHHLQFPRPFSVQTLKSLDLHMSSSTKSRKELEKNYAKLVAKNKEDEDDVDPFLDEQDESSEITNESVYTNETGNTSDIKEGRRGLKQRFKMLYSTSSIAAPRSDLRASSTESLSLKTDQDRESAMKKLRKYFHADPSEELMAIYKVYLRRSIPVYGRLFLGKEKLYFKSLLPGVSTKMILPLKNIAECRKRVGSVVKLAGISIVLHGREVICLEFRSKSARNECERLLSVQSKACQSTPKIERLQQEVELSTALQNSEDSDELLEEIEKKEIEELAYRRVREARVRLLEDRLSTASGIEFPLIIGEDPIFFSEIKSSVSYNFVLLTIGSRGDVQPYIALGKQLIVEGHNVTIATHGEFRDWIVSHGINFKEIAGNPAELMSLMVRHGSMSVGFLKEASLKFRGWVGDLLSTSWKACQGADVLIESPSAMGGLHIAEALGIPYMRAFTMPWSRTRAYPHAFIVPDQKRGGSYNLFTHVMFETVFWKGISGQVNKWRVETLGIPRTNLARMRQTQIPFLYNMSPEIFPPSVDFPDWVKVTGYWFLNEGAGDYKPPDDLVTFLKKARAENQKVVYIGFGSIVVKDAKSLTKAVVDAVLASGVRCVLNKGWSDKLNDEKAEKTKIEVELPEEVFSCGSVPHDWLFKQVDAAVHHGGSGTTGATLRSGLPTIIKPFFGDQFFYASRVEDLGVGLALKKLNAKSLANALKSITTNTEFAMKAQAIAENMKQDTGVMNAVAAIYSELTYAKTLIRSIRLSNEQKRNSDDDLDSSAQLTGSESVDSDL

SEQ ID NO: 7938 - protein, 1383 aa, Exophiala mesophila
MSAPDHAPRRTPSRRLQKRNPHLNRLPSPSLPSRLRGADDDQEDVTAASRGNKTSAQYMNQSIFSMIAAAGSKTDFNARFDESSDSEDDAIQEEDQDDLQHESPRHMTSTFAPLHSTSTSHKKKPSLSGKLAQSLPRLSVRSASKKQTRSAPKPSPSPTSDTTSKSATSNPREAPVLSRLLTAEAEFQENTDLALEESYPEASTSRSRSESSPETLLAIRLMDIFALERPEKVVAEYPCWLLKSVLLQGYLYITKQHLCFYAYLPKKSHSVAKTGYLAKKGRTTAKYKRYWFSLKGDVLSYYTDPSDLYFPSGHVDLRYGLSASLSSDKGRPDTKDFTVTTDHRTYHFRADSAQSAKEWVQSLQKTIFRSHNDGDSVKISLPLQNIIDFEESPVVEFAETVKLRVVENDDSYAIDEYFFSFFSCGQDALTVLGDLVTKAPSKSPQIETSPARRVTQSPDPSPRFRPFSQRAISEGAVLRPRHRSSSPARDSVRATLVPFSLGDDGKMSPRLSGEFQRTGSPSRSSGDFGPDYGRASFDRGRRSGSTSRLEVAKVKRSGRSPLAKHQDSEDSFVQSIDKETDSSTAPLSPTVEAQMSASQILTRSDVFHPPPVRRMATLASVSSEAGLKSSMDATVLSSSPPQDGSAPVPIIDKSDPATRMAKDRRAAVQHDADMDSEKRFSSSPTLQDIVRAGSYPLQRAGAFADYLKSHSVSMKKLLTTEPMTYLEKVSGMWTGGRKHYGENEGIVSEDRGIDPEDEEANVGHGDRFRAHFALPQSEKLRATYFCFLHRVLPLYGKIYISNRKFCFRSLLPGTRTKLVLPLKDIENVDKEKGFRFGYHGLVVVIRGHEELFFEFSGSEHRDDCTVTLLHSLERVRYMVGSGILGHQDEDNAEIAKEEHRLLQEARRKSAGDHQIVLPDTAEAIFSHEDRREVLFEDPRADIIKFKPAQSLRITCLTIGSRGDVQPYIALCKGLLAEGHKPRIATHAEFGPWVIQHGIDFRPVDGDPAELMRICVENGMFTYSFLREASAKFRSWIDELLSSAWEACQDSDLLIESPSAMAGIHIAEAMRIPYFRAFTMPWTRTRGYPHAFAVPEHKMGGAYNYYSYVMFDNVFWKAIAGQVNRWRKKELGLRSTNLDKMQPNKVPFLYNFSPHVVVPPLDYSDWVRVTGYWFLDEAKDWTPPKELTDFIAKARADQKKLVYIGFGSIVVSDPAALTKTVVDSVLKADVRCILSKGWSDRLGDPSAVKTEVPLPPEIHQIKSAPHDWLFTQIDAAVHHGGAGTTGASLRAGVPTVIKPFFGDQFFFGTRVEDLGVGLCLKKVNVSLFSRALWEAVHSERMIVKARLLGEKIRQVSLNSRILFLTYSARPPACSFSDQSDVPLT

SEQ ID NO: 7939 - protein, 1166 aa, Hebeloma cylindrosporum
MRAGTQTLIQALQALPWMNSDNDEDGPPDPCSADESEDDERPTVQRLSSSIHTIHRPLARSHRINIPTSSKPLSQPPPFEDPLEDISASDEDLENDFEETPRLSSDGPLQQAADTAVSSGKEPTFNAMGDRAGSMATVRLHRRARLAEKLKEVYDLDDIREVWAEMPCWLLRSVLLQGYMYLTNSYLCFFAHMPSREDQVLKSGSLNKKAQRTKRWIKHWFVLRNDALSWYQSSSDPYFPHGIVDLRYAISCETSGERGFRLRTNSRTIVLSADSVPSREEWVKAIRKVIFKAQNMGESVKIAIPYSAILDVERSTAMDFSETIEVKVVDKEDNFALDSYFFAYFHNLPGALDQIRDAVRNHRSHSGVSEDKAPAVLDTTVSRSPLTPERPNTVESTTFKAASGFRLSSIFRPFSDPPTTIKGSSTPATSELQSDDYTHVFRKPDSSSFIPLSTSPKPMLPRAHDELSETSTGQSTQSLPPPEHTRDNNSSSWAVGVPSWLKSSKRVFGGSSGTESPTTFISSPVKEVYSTAASSPGPISRSSGVGDMAFSVLETPDMLPDQDTAEKFRSAFAYDDRETLLGYFPGYIYRLLPVFGKLYISTNYFCFKSSGPLAARTRMTLPIRDILASEKSKATRFGHHGLIIIVKGHEELFFEFGAEDKRDAFVHLLERQMEDVRKRLASGESILPSPAHRDALILEEFETRNSTSSEPDPTPLSDTMADSLPAVMFTSASSTFLTFKPKRSLHFTFLTIGSRGDVQPYIALAKGLMADGHRCRIATHGEFREWIESHGIEFGLVGGDPAELMRICIENGTFTVSFLKEGLLKFRGWLDDMLKTSWEACQGTDVLIESPSAMGGYHIAEALAIPYFRAFTMTWTRTRAYPHAFAVPERKMGGSYNYMSYVMFDQVFWRATSGQINRWRRNLLHLNPTSLDKIEPHKIPFLYNFSPNVVPPPLDWPEWIRVTGYWFLDDADVSAKKWIPPPALVQFIDNARANNHKVVYIGFGSIVVPDPKAMTQCVIEAVLRSGVYAILSKGWSDRLHIKTGEAAEPEEPLPPQIFPISSIPHDWLFQRIDAACHHGGAGTTGASLRAGIPTIIRPFFGDQFFWADRVEALGVGTGVRKLTVSTLSEALLAATTDPKQISRAKTIGEQIRAMASQLRSSLSIET

SEQ ID NO: 7940 - protein, 1148 aa, Geotrichum candidum
MGFRRSFNTSSAKARSSSQDCAATLPDSEYPSPDFLKFISKAAMESAHQSIGEEDEDDEDDDLESNPAVNEQDHITGSADSSSKSNCSEPHSKLAKSVHSLMTAHDEKDQKADYITDTLRNQLGVDENDVLLADYPCWLLKNILLEGKLYITNKEVCFLAYLPIVQKSVIMSGRLTRQSRRSSNTYWFVLRNDLFAYYNSSTEVYFPTGTIDLRYAIKAEMVPDDKAPSRSFYLVTEKKTYTFKAESSTVAHSWVQALQKEIFRSRNEGDQVKIKIPIANIIDLEETVSFDIVDTIKIKAIDSDETYSIDDYVLAFLPGSQSFQLPAETIRKTIERVNAESMPDEDIDRLTRSHRTIGKVLDSTIPPGGISPGQSPDRERSVSPSGINPISSLSHTVTKRFSALGSLVSFDSLSLVDKVLLPKESKSHSSTESKSPLSDLESNDSSFAIVSTHLNSPGKPSANNVSDRKKRGKQWYPSTAINKVTELWMGGTKHFEDIVDEDDKYLVPEEDRNESNERFRSHFSLGESEELVASYYAHIQKAIPIYGKIYVSHNYVCFRSLLPGTRTKMILPVKDIENVSTERGFRFGYSGMVIVVHGHEEIFFEFGLSQNRDDAVNIILKQVDLYRNRSSATLPETKVERARLFTYEDAIECNHLMASKYMTSNNVPTEVHELKPLKFVLLTIGSRGDVQPYIALAKGLMAHGHKVKIASHSEFREWVEGYGIEYAEIAGDPGELMKIMIEHGMFSMSFIRDAASKFRSWIDDLLMTSWEACIGADVLIESPSAMAGIHIAEALQIPYFRAFTMPWTRTRAYPHAFIVPGQKMGGSYNYLTYVLFDNVFWKGISGQVNRWRRKTLKIPKTSLDQMQQNKVPFLYNVSPSVFVPPVDFSDWVCVTGYWFLDEGAGDFKPPADLVDFIARAKHDNKKIVYIGFGSIVVSDSNELTRAVIESVQKSGVRCILSKGWSDRDAEHGKNTEHRPEIQLPPEIFQIKAAPHDWLFPQMDAAVHHGGSGTTGASLRAGIPTIIKPFFGDQFFYAGRVEDLGVGIFLEKLNVSQFSKALVEATTNEKMMARAANIGERIRNENGVETAIDCIYREMNYAKSLIKHNNGTETRLGMLGKVFHTGSSSPPPQDEDDEETKTDDSWMVV

SEQ ID NO: 7941 - protein, 1328 aa, Crucibulum laeve
MRAGTQTLIQALQALPWVDPDNDDEPVSHELGPIDSESEDERPSFERLSSSIHAIHRPVARSRQLSISIRPRATQPGTHTQVVDEEEPQETLSSEEEGDDEDFEEDTPRPPNSRPAHIQHQSLPASQVQGVNANPFNSMNNRTGSMATIRLHRRARLAEKLRDVFELDGITEVWAGTYAVEMPCWLLRSVLLQGYMYLTNSYLCFFAHMPSREDQILKSGSLNKKAQRTKRWIKHWFVLKNDALSWYQSSSDPYFPHGIVDLRYAISCDPVGEKEFRLRTHQKSVVLSADSVPSREEWVKAIRKVIFKAQNMGDSIAIPYSAILDVERSSAMDFSETIEVKVVDREEHFSVDSYFFAYFHNLPAALEKIRDAVRTHRTLPDKGFSKGVVLDTTVSRSSPSAAPPLERPLSLPLEPISNKNSSGFRLSSLLRPFSDTMSLGRSGSGSNSVPESLPDAEDYTHISQRSTSSFIPVTTSPKPMDEQSFSTDKIQDGSKLPIQARLPVEHTYPPSTSRASTLPDHPSLSRDSSSSWGVGVPSWLKTSRKVFGGSGQTEQISTSEPGVREMYSSATLSSSPGPISRSSGLGDMAFSVLETPENAIDAEAIEKFRSTFAYDEKETLLGFFPGYIYRLLPVYGRLYLSTNFFCFKSTGPLAARTRMTLPIRDILAFEKSKAPRFGHHGLVIIVKGHEELFFEFGDEEKREAFGLLLERQMEDVRRRLATGDTTMASPGKREALILEEFEARSTSSDSDPAPPPESMSDSLPAVMFTSASSTFLTFKPSKSLHFTFLTIGSRGDVQPYIALAKGLMADGHRCRIATHGEFKEWIESHGIEFGYVGGDPAELMRICVENGMFTVSFLKEGLQKFRGWIDDLLKTSWEACQGTDILIESPSAMGGYHIAEALAIPYFRAFTMTWTRTRAYPHAFAVPERKMGGGYNYMSYVMFDQVFWRATSGQINRWRRNLLNLGSTSLDKMEPHKIPFLYNFSPHVVPPPLDWPEWIRVTGYWFLDDADVSAKKWSPPDDLVKFIDGAHKIGKKVVYIGFGSIVVSDPKAMTRCVIEAVVQSGVYAILSKGWSDRLHVKAGDAGEPEEELPDQIYSISSVPHDWLFRRIDAACHHGGAGTTGASLRAGIPTIIRPFFGDQFFWADRVEALGVGSGVRKLNITSLTEALLAATTDIKQIERAKLIGEQIRGEDGVATAIESIYRDLEYARSLIKRTNRESTDDDEDEEFDAEHSTIRYHDSTFSAGSPPGSFSGYSSSGSIHGAPSEDWSVISEQDDRRSSISSRYSEGRAKEKRTSFTAAVLSVLPDSFAAGSSPRRRSASVSSRS

SEQ ID NO: 7942 - protein, 451 aa, Anaeromyxobacter sp.
MVRRQRPCEAAGRRPAMRIALLTAGSRGDVQPYLALARALARSGHACTLVTQRVFAPLAAEYGVTFHAAGGDDWPTPESVRERVRNGELAELAGKRNSFSQLSLVAALFARHMTRFTADALPACEGVDAVAFAPMAAVAGHSLAEKLRVPFVPALLAPAFSTREFPSVLFPPRASFIPGYNRLSHWAAERLLWRLNRESAIRLRRDVLGLPPYPRSAFELMHRAEPPVLVGVSPNVVPRPRDWAPYLHLTGYWFLDEPSGWNPPARIARFLASGSPPVCVGFGSMVSEDPRGDVRIVAEALDRVGRRGILLSGWAGLDDHAADLPSSILPLDSIPHSWLFPRVAAVVHHGGAGTTAAALRAGVPQVVVPFITDQPFWGDRVRRLGVGPAPIPRARLTAERLARAIACALERGAMTARARDLGHTIRAEDGARLAVEILERELGRGRRRAPG

SEQ ID NO: 7943 - protein, 550 aa, Laccaria bicolor
MAFSVLETPDIAADQEATDKFRAAFAYDEKEILLGYFPGYIYRLLPVSGRLYVSTNFFCFKSSGPLTSRTRMTLPLRDILALEKSKATRFGHHGLIIIVKGHEELFFEFGAEDKRAAFVQLLENQMESVRKRMVAGTSAATTSPGKRDALTLEAFETRSIGSDCDPSPPPENMADSLPALMFTSASSTFLNFKPHKSLRFTFLTIGSRGDVQPYIALAKGLIADGHKCKIATHGEFQAWIESHGIEYGYVGGDPAELMRICVENGTFTVSFLKEGLQKFRGWLDDLLKTSWEACQGADVLVESPSAMGGYHIAEALAIPYFRAFTMTWTRTRAYPHAFAVLQLQNMGGSYNYMTYVMFDQVFWRATAGQINRWRRDLLHLGPTSLDKMEPHKIPFLYNFSPHVVPPPLDWPEWIRVTGYWFLDDADVSSKKWTPPQDLIDFIDNAHQSRQKVVYIGFGSIVVSDPKTMTRCVVEAVLQSGVRAILSKGWSDRLHVKSGDDVESEEALPAEIYPISSVPHDWLFQRIDAACHHGGAGTTGASLRAGIPTII

SEQ ID NO: 7944 - protein, 1487 aa, Drechslerella stenobrocha
MSSEVEDRPTRSTRVDLPARARPRSHSPALPDRFKIASENDLRDVSLSGRGGNFSMHQSVFQMIQAAGSKVDFHTRFDSDIEEEGEGDESSDEEGKQKTMKNTVPGGLKDATKDRARALPELPSADLSASKRLSDSRFLPKNILKSIQQKRHDKRSRPSSSAASTSEDIGSSTELNSSQGSIHIPSTSRSAPVSDLPSLAHSTTTVTNSAAAVAEDLDNDDVLFPEFSITATALSEKVQKIFHLAELEEVQSEYPCWLLKTVLLQGYLYITDRHICFFAYMPKKQDSVLKSGHFYKRGRKNPRYGRYWFTLKGDVLSYYSDASELYFPSGNIDLRYAIHAYADEGSKDHTFTLVTNSRKYEFKADSATSAIEWTKALEKVIFRIHNDGDSVKVVIPIENVLDIEKSPVIEFADTFKLKVVADDESYAIDEYFFSFFSFGAEAFELIRLLVEDTTAQKIPSHLLTQGPSIGAAFASKKSSATSSPARDKCAVSPARSLRNSLVIGVPTVTVQARGGDGTVAPLLREAVRDTLLPVPTSPAVGSPRNSGEYTRRSMDINRRSVDVAHRRSTDLSRKSLDTTEYRSPSLASAIKQKIKSHKHSNSTSTAQSASMDMSSSSYFKSIRSEPSLAESSDAVPISSESEGELAASQLLSGSDIFQQAFPAGTEPSGIDRGRSPTLRNKAGTIAPAEGPPLQVHPPSRTGTDTGVLAPSAEVKKAETSPGQLGRSSLELSSSDKRFAISSPSLTDVYRVGSLPIRGAQGIADWMKRRSKNVASGGMGYFGKVTDMWTGGKKHYDDKAVSPADAAGENADADDEDEGVASPSERFRQRFALPESENLMAVYFGYLSRVLPLYGKIYLGDQHFCFRSMVPGTRTRMILPLRDVENVDKERGFRFSYHGLVVTIRGHEELFFEFASLENRDDCGSTLTRAMDSARQMRQSQLITPEQKANAEIAKREHDMLQEARQEAGHLEHEIKLPHTTNEVAGENAMDVPPIVFDDPHTSIVHFKPQESLRFTCLTIGSRGDVQPYIALCKGLIKDGHKARIATHIEFKDWVEGHGIEFREVAGDPAELMRVCVENGMFTISFLKEASSKFRSWIDELLDSAWIACQDSDVLIESPSAMAGIHIAEAMRIPYFRAFTMPWTRTRAYPHAFAVPDHKMGGAYNYFSYIMFDNVFWKAIAGQVNRWRKKDLHLKSTGLDKLQPNKVPFLYNFSPHVVIPPLDFSDWIRVTGYWFLDESQQDFEPPQEMVDFMRRAREDGKPIVYIGFGSIVVADPQALTQTVVDSVVKADVRCLLSKGWSDRLGKKDASAPEIPLPDCILPIKATPHDWLFRHIDAAVHHGGAGTTGASLRAGLPTVISPFFGDQFFFGGRVEDLGVGVCLKKLNVKTLSEAMWLATNSTRMITKARILGESIRSENGVDTAIQAIYRDMEYAKTLIKNPQLDSPDGTEESWTFVNQDESDAEVARRNSTKDTNSDRSSRATVASEL

SEQ ID NO: 7945 - protein, 950 aa, Sphaerobolus stellatus
MGESVKIVIPYSLIVDVEKSTAMDFSETIEVNVMEKTAGFSVDSYFFAYFRDPGHALEQIRDVVRSYKQSSTGEGVGEVKDTTATRSSGEHSRTPSHSEKTLSPGEHKASAFRFASLLRPFTVAQTAQRSEFPFSDSEPVVASLSASPDELSSSVNTLTTRAYSLPTATPDAGFITGRREVTSSPGTLSDIEDLSLSSDHTYPPPPSPGSRPTVESHGSWNVGVPSWLRMPGRKVLSSINFLHSSSSDRVREVYSPGPSMDQSLDDSSHPHMEFSMIDAKEAPVDPEVVTKFRASFALDEKEILLSFFPGYLFRVLPVHGKFYISTSYLCFRSSQPLVKTRMMIPIRDILRPEPTKGYRFGMHGVVLTIKGHEELFFEFNSIARRDTFVELVEQQCETLRERQLDGGHASPSPAKREALFLEELDVSKSLSESDPDPILESQHAESLPAVMFTSSSSTFLTFKPKESLHFTFLTIGSRGDVQPYIALGKRLLQEGHRVRIATHGEFKEWIESHNIEYAYVGGDPAELMRICVENGMFTVSFLKEGATKFRGWIDDLLKTAWEACQGTDVLVESPSAMGGIHIAEALKIPYFRAFTMPWTRTRAYPHAFAVPEHKMGGAYNYMTYVMFDQVFWRGTSGQINRWRRKVLGLPSTNLDKLEQHKVPFLYNFSPAVVPPSLDWYEWIRVTGYWFLDDADVGARKWTPPDGLVEFIDSAHAAGKKVVYIGFGSIVVSDPGAMTKCVVEAILKSGVYAILSKGWSDRLAIKKPSADQPKESYPPQIYPISSIPHDWLFPPGIPTIIKPFFGDQYFWADRMEALGIGSCVRKLTIDHLTAALITATTDERQISRARAIGQTIRAEDGTGKAVESIYRDLEYARSLIKRGDDSDNEHNHHILSRSPSRGAGGQSSSSSARPASEDWSVISEQDDHHRIPAHVDDHIEPPFTATPLQRI

SEQ ID NO: 7946 - protein, 1506 aa, Pseudozyma hubeiensis
MGLRPLFGSRASVNDIHDSFGTTLEAVKTSESEHADPLEQQHSSHAASSAQEEPLSPQSSQPQGGNGLAGFLNGAALMSHKDSQSRSEDRHDNDVAVPLDSQAQKSDVAAVDANSSDDAAAWKKSRNEAETSDRYESSRARSKLGRTLKKVDAKIRSTIGVNAPPTAQEMRSPYSVGNNDHLTSQNNLGAAELLNDARLETLQHLSDDEEDDSDDQDEDDGDDEEHTLHDKSDQHIENDDDDAKTLRDSDTGPDPAKIQEHVAKLDNANSSAEHRRSGSMEGVRPGDSIRTRAPVEISAEDKMKAIIEEFGECPSVSQPNEPEKLIVDHNGVLMKTVLIKGSLFLTNRRVCFLAYIPDAASNNDNAVEHHQAGLATGKDSSAVRAPSDPNVDNPILKSGPAVIHRPGKLRPKRRVWMELRKDSFNAYSASNKLYKPLLSARLSNLYAILPVDWAQPNVIRFVEGLKYSSVEFKTQEAALDWRKELEAAAFHARNTAEKVRISIPLERIVGTDAADFMHVARILHVDVLVGAVTDSEIAQIEQEHRERADGHHIGRSWSSGNSFLTCPKNPGFKCHVTQVAFGVTHNRAAFIDLLREALKASRSVQHNLGYKEMLQALPSPLLDLQGEADVEEGAADSSTSHDDQKSSLADKFCHAFGLPTRADELHLVKAELVRTLHTHGTIAIGLDYLLFWRRAVGRDLKIKVPLNDLQGVDTYRSMLWHHFGLVVHIRAHADMHFDFTSKENRDMTLHKLQSFIDAKQKQSKESKNNADGQALESGAKSADGVQTTPSKKGPAETLLHDAAAEVPVFEPDVLALLPKVVNMDRDAMRDAIRISPMRIYCLTIGSRGDVQPYIALCKALKEHGHTPVIVSHPEYRGWVEGHGIEYRGVGGDPAALMKLSVEHRIFSPAFFKESIGKFRVWLDELLRECWEECQGADLLIESPSTMAGIHVAEGLGIPYFRAFTMPWTKTSAYPQAFSVPSIEMGPSYNSSSYTLFDQVMWVATSGQINRWRKHMVGIGATDMSKMDADSVPFIYNFSPAVVPMPNDWGDRVKISGYWFLDNPESNWKPPKEMQDFLERARKDGKKIAYIGFGSITIENAEEVSANIMKAVHEADVRAIVAKGWSGRGGSKRKKKKQQHKQHDAKPHLQHKDSTSSHTESEDTATEEEHEPEITIPDDVFVVDSVPHDWLFPQIDIAMHHGGAGTTGASLRAGLVTLIKPFFGDQFFWANRVAKLGAGARVNGLSVSDLCDALKSAASDRVMVEKAQGVGEKIRSENGVATAIEFLYKNIPLANRRTQRRLEREATHDSTDSSYRTNPLSRFGTHSRQNSASGSEVKEKHGQTKRSATLPPVSTSSSEKSGDIHRSSTIFESPADELNSPSSPTSPSSPSSGNRTLLPSLPSLSTLNPLPSSMSSSLKEMIAFHTSTADTTADGEPAHPERSNTTPPGRLAPEDETDEQKMHRLKGYKNAKAEDIRRRKLLLERLEREKLQKEQQSQTGRKEEQHT

SEQ ID NO: 7947 - protein, 843 aa, Aureobasidium melanogenum
MKGHGSIDSDSTLSEDFEAGSLPPPRYDQIYHASHDPETVELGAEGPYHIRDDGRVDIDFNSSVIRAFSKCFPSAPDEDSQPAPPAYESKRPFDPSTASSLKWNIKLNIVIQVVGSRGDVQPFIALGTELQRYGHRVRIATHDMFAAFVRQAGLEFYPIGGDPASLMAYMVKNPSLMPSMKTIMSGEIGRKRQMVAEMLSGCWDSCVLPDQFSGQPFVADAIIANPPSFAYIHCAQALGIPVHLMFTMPWTSTRSFPHPLANLTNVDESHAAANYMSYHVVELMTWQGLGDVINDWRESIELEPINFLDGPALAQMLKVPFTYCFSPGLVPKPEDWPEYVDICGFFFRDDPACTPEPGLVDFLAAGPPPVYFGFGSIVLDDPAKMLSTILGAVKAAGVRAIISKGWSNLDGDASENIFYIGDCPHEWLFPRVAAVVHHGGAGTTACSLKNSRPTLVCPFFGDQPFWGHMIANSGAGPDPLPPRHMTIDSLAEAIRFLMRKETALAAEVIAERMDREQGVQAAVNSFHRHLPLETMQCDLIPDQPAVWTIKSGRREVKISKLAAEIAISQRNSLQKDLKTYRTKPLIIDPIRWEPLSGGISASVGTTVDIGRCLTGMVTEPIKAYSKERRRQDRIDATERLEESQQLAESSSSIHTVTSTKSRGKQPSAGGKAALAGAKSLGWLAPKAIKGAAVDIPLALAEGFRILPKLYGDEIRDHGRVTGAASGFAVGGKTFAYGLYDGIAGLGVQPYKEYKKSGAVGIVTGLGKGLAGLVTKPGAAAVGAWAYPTAGITKTIRSAVYNKSRKLIEVQRAAEGRWLAEQQQWTGSQKIALMEKFNELGSKK

SEQ ID NO: 7948 - protein, 1213 aa, Kluyveromyces dobzhanskii
MPKESSELQQYPSKFTKSMFVDSRAFVKKSLSPVDHLCHSVADLRFASFNSETLESRLQAITKKFDNGSESQSTAEADTVEDVAKPQYMAKSFAGLLATASMCVGMDELGDEEDEDEDELGLMNDAASVFDSKSQTNRTLFEVSVEMNTDAVSQLSTDSKSRKEMIRERLIKKFLPDNDEKYIEEYPCWLLRDIMIQGHVYLTDKHLFFFAFIPNFESEFNLTGSLSFVNGQGLSKGHRYWVVLKGHTLSFHNSSTELYFPLLNVDLREISAVRIDLSEANSTKFELNVNEQSLIFKADSFHSARHWVSSIKKQMFAFQHSETNTMTVKIPLQNILDLEETNILDRSGTLRIRALENSSTYAVDEYFFVFFKGSAQAMKQKVNSLLKDLEMNGSQILIDFNNVDSPTSSDDKELGINNENSELDDRTIGDDKFSTAGTSGVGPNVLESGSPMGQASAGPNSRHSKYPRKVKKKLKSMAGSLKIVSPSRLPKLEDDIIIEHYSPGLINDQTMDYDKDCKSIISRFTPKKFQNVPLMWAADPVHFNSIDGISFPLEDKYTAATDVNTQSNTRFRHHFSFDDAMNLIASYHGYLNKNVPIYGKIYVSDKNICFRSLLPGISTKMVLPLDDVENCYKETGFRFGYFGLVIVIKGHEELFLEFGNKNARDDCEFVIMKVMDIFSHRKSPLQRKSTAEVVHRLSEAASIKLLEEKISEQGFDIPLIVEKNPYFTTVIKPSRSYKFGLLTIGSRGDVQPYIALAKGLKSEGHEVIILTHSEFKNWIVSHGIGFREISGNPAELISLMVQHGSMNMGLLRDASTNFSSWISSLLETAWEGCQGIDILIESPSAMAGIHIAEALKIPYFRAFTMPWTRTRAYPHAFIVPDQKRGGNYNYFTHVLFENIFWKGISGKVNEWREKALHLPRTNLVSMQQNRVPFLYNVSPIVFPPSVDFNEWIKVTGYWFLDEKQSYTPPSEFLEFIKKARELKKKLVYIGFGSIVVNDPDKMTETVIDAVGDAGVYCILNKGWSNRIGDPQAKKIDKELPHYIYNSGDVPHDWLFSKIDATVHHGGSGTTGASLRAGLPTIIKPFFGDQFFYAGRVDDVGAGVALKKLNRASLAKALKEVTTNTRIIQRAKQIGESISKEHGVATAIGAIYSELGYARSLIKARDSSTDKEKAADMQTIEKSLKSGNEAEKVDSNFEESGSGSGSNDGSWLLV

SEQ ID NO: 7949 - protein, 637 aa, Arabidopsis thaliana
MPEISPAELAKVSSSSSSSSSSSSGRASVKIEEIEGGAAASGVVIVSEELETNPKTVVASIADETVAESSGTGNKSFSRVWTMPLEGSSSSDKAESSSTNQPRLDKSKTERQQKVTHILAEDAAKIFDDKISAGKKLKLLNRIATVKHDGTVEFEVPADAIPQPIVVDRGESKNGVCADESIDGVDLQYIPPMQIVMLIVGTRGDVQPFVAIAKRLQDYGHRVRLATHANFKEFVLTAGLEFYPLGGDPKVLAGYMVKNKGFLPSGPSEIPIQRNQMKDIIYSLLPACKEPDPDSGISFKADAIIANPPAYGHTHVAEALKIPIHVFFTMPWTPTSEFPHPLSRVKQPAGYRLSYQIVDSLIWLGIRDMVNDLRKKKLKLRPVTYLSGTQGSGSNIPHGYMWSPHLVPKPKDWGPQIDVVGFCYLDLASNYEPPAELVEWLEAGDKPIYIGFGSLPVQEPEKMTEIIVEALQRTKQRGIINKGWGGLGNLKEPKDFVYLLDNVPHDWLFPRCKAVVHHGGAGTTAAGLKASCPTTIVPFFGDQPFWGERVHARGVGPSPIPVDEFSLHKLEDAINFMLDDKVKSSAETLAKAMKDEDGVAGAVKAFFKHLPSAKQNISDPIPEPSGFLSFRKCFGCS

SEQ ID NO: 7950 - protein, 895 aa, Rhizoctonia solani
MLHGSRKGGAPLKLYITAAYTDDHQRTPLTGGCNTYNTLRLSLAINTMIIPDDYDSKKAPSEHEDQTEYSREIRMGSESDSKQGRSVSASDFPHPPDNSELGPPRYEDIAQSASSVRPPVDVKSEIDPRRESFQTRTSTSSSVREDEPNAEFRTAAMAASAAFQPDGRFQVSIDAVPGKLPRDYAVPINEPGIDSTDFVNAPPMNVNIMIVGSRGDVQPYLALGKQLRQHGHTVRLTTHETFRKSVKDAGLRFFNIGGDPHELMSYMVRNPGLMPGFESLTNGDITRKQMMVAEMLERCWRSCYEPDEAQEGSLSFAADAIISNPPTFAHIHCAEALGIPLLMSFTMPWSPTTSFPHPLVNVRNSQAEPRMTNYLTYGLADAMTWQGLGHTINKFRRKRLGLPSLSVISGSGIIERCGVPWTYCMSPTLVPKPHDWVNHIDVVGFYFLDLATKYTPPEDLVAFLDAGEPPIYIGFGSIVVENPIEMTKTVLSAVNQSGVRAVISAGWGSLDSSTLQDAGNPNVFILGNVPHDWLFERVSVVVHHGGAGTAAIGLRCGKPTVVVPFFGDQPWWADQIHARGAGPAPIPHKQLTVPALMGAIRSALSNEMRAAARRVGELIRSEDGVKKGMDSFHKHLPLLDMRCELDHKKVAVWYSRSHKLRLSAFAAQVLAERGILDVNKLELHRPREYITRVQPSDPITGALAPTLGVVGDVFGGVGGLFTPRPEKGVIKLVKAGPEAVRGILEGLHHGTNNAPKIYGGSVREPGKITGFRSGLREGGKSMAMGLYDGLTDIVREPVDGFKKHGVLGGAGGLIIGLTNAVVKPTAGAIGLLSQPVEGTIQSVRSLMAKPAKERHATRYAEGVGAYKESSEAEREAVIRAFEKKRSRSKGKQKAT

SEQ ID NO: 7951 - protein, 1516 aa, Candida albicans
MSFYKKVTRGLATPLQGSINLFSGSPNVSGDEGTDADNENPEHRTTYHSLSGRVNHDDDDEDVAKLEDIVGFFTGLLNTTTVCAGLGSLNNLKKHYLDEFIKKSALNPLRPQNYGPETSSKLNNNSIEELLNNGDTSLEKVRKMSLYDFDEHTSDSEEEDSADKEEESIAENLKPGKSGKARNHPRDSRTTATLITTQITRTRTATATTATPTPTPTSSVDTDVTDVTEPIGKVTTKIPEEQLQGLNPLQKSVVKNLDPHHVREGVLIKVKNSETPLKNDRQELLEKIQLRLKIADKLQRVFDLSDEDTFCGNYSAWLIKDVLLQGHVYLTKDALLYFAFLPKRFSLENSSEVLDEDNSSSIVYSGNLGLKSAKYGEVVLNTVLQHRYWAVLRAETLSIYSSSTNLYFPVLVIDIKKCLYTEIIDKEKLNREAISPVNRGTYSPNGGLSGTATPRASTLENTASELNSMLSGDSYSPTEDNVETTASTVWFKLVTKKKTYKFSCDSSFSARQWCNNITKLIFQHNNANSNGEVLIKIPISKIAEYNKRALFSEEEEEDRTLDATMNDIPLNVTIKYLGDNDNERKRDKLKRKYKGEEPTIEEVHFLFPKSGVEFFETFDKLVNPVVSDNDNQSSKSSITSTNFSEKAISTLSKSPNHLVQTVLDFNKPVDDDISAFKKFGTTITSPTRIFKATITSPEMTSIDETSLRDSFDSDRLHLPRDMSERALKNLEVPFVTSLKKLEDASKRYEKPHMEHSQTNLASILSDPSEVKKESKTAISKSIKALYSVGTHWSATPNHYFELGKYYVNKVQERDSSQRNFQSHFSTNSKLLASYYGHLLRTVPVYGKIYVSETDVCFRSLLPGVSTKMVLPMTDIEEVRASRGSRLTYHGLRLIVRGSEELDLEFGSSKSRDDFQKVVLSVLERLHSKEGFRPEPYQWGSNFEVELYKTRMEYSDSENREIQQYDNSIDIKFAEKKIEMARVRMFEDRLMAASGLDVPIILEDSPFFKTELRPSTSYNITLLTIGSRGDVQPYIALGKGLVKEGHNVTIATHAEFGDWIKTFGLGFKEIAGDPAELMSFMVTHNSMSVGFLKNAQQKFRSWISKLLTTSWEACQGSDILIESPSAMSGIHIAEALGIPYFRAFTMPWTRTRAYPHAFFVPEQKKGGSYNYLTHVLFENIFWKGISGQVNKWRVEELDLPKTNLYRLQQTRVPFLYNVSPAILPPSVDFPDWIKVTGYWFLDEGSGDYKPPEELVQFMKKASRDKKKIVYIGFGSIVVKDAKSLTKAVVSAVRRADVRCILNKGWSDRLDNKDKNEIEIELPPEIYNSGTIPHDWLFPRIDAAVHHGGSGTTGATMRAGIPTIIKPFFGDQFFYATRIEDLGAGIALKKLTAKTLGDALVKATHDLKIIDKAKRVSQQIKHEHGVLSAIESIYSELEYSRNLILIKDIHNQNYKRHHPVPSGVQTPAYDTDSDDYDDDEDDDESDKDDEEEEEEEENSYDGYDGNGVNNSRSQNSSN

SEQ ID NO: 7952 - protein, 803 aa, Aspergillus niger
MEKDPRLGYSDPGSSSYDQAPPPYSPYNDSGPVVESADVQANGRVNVDLDSSLARTLASIIELQQEDLQNPPPNYSEDQLIKDELLQCDIQLNIVIQIVGSRGDVQPFIALGTELQKFGHRVRIATHDVFSDFVTQGGLEFYPIGGDPAELMAFMVKNPGLIPQISSLRAGEVQKKRAMVNEMLHGCWKSCIEDDPVTKIPFTADAIIANPPSFAHVHCAQALSIPVHLMFTMPWTSTKAFPHPLANLSSSEMNPNVANWVSYGVVEWLTWQGLGDVVNRWRASIDLEPVPTAEGPRLAETLKIPFTYCWSPALIPRPRDWPANIDVCGFFFRDPPSYEPPLELKEFLESGTTPIYIGFGSIVIDDPQKLTEIILEAIAKTGVRAIISRGWSKLGGVPSSNTYYIDDCPHEWLFRHVAAVVHHGGAGTTACGLANGRPTTIVPFFGDQPFWGSMVARSGAGPRPIPYASLNAENLAEAIAFSLRPTTAESARGIALKMQHESGVAAAVRSFHRHLPLDRMRCSLIPNQPAMWIHKRSKKSLKLSKVAVQLLIDNGKLNAKELRCNTINPIHIENRRWDPVTGIISASTSTGSAMLKSTGEMLYNPYKEYTSSHTETSINSGPNNNALSTAGNMVGASLKGFGKFTGAYFKGVVVDIPYAAAEGFRQVPRLYGEEPKQYGTVRDWKSGATMGGKNFVDGMTDGFKGLFTQPIKGAREEGALGAVKGFAKGTIGLATKVPSAGIGLVAYPFQGIAKTIEAAVRSKTGKAILLARLRDGYAMTERAHMTEDEQQYLLRRFQALTDP

SEQ ID NO: 7953 - protein, 1448 aa, Exserohilum turcica
MASQDRERERMPRGLSRRRRDSRRESRGMSLEMPERFRDGDDAEEDVTAPKRNNAVSMNQSLFSMIARAGQHSQTDLGTMQEGDSGDSDDEGKPKAPYQALDGAARLSRLSSANEFQTPAQECHETSTENGKHRRTLSENRLLRSLPKLKVSSRKEARPEGQRAQMSSSQFLPPKPSPSPSPSALPKRPSKPKDKEKDKLTAGEEIHVETAPSASRKSRHGSTTGVDKSQEPATLAKRLQQIFEFDEVEEVIAEYACWLLQSLLLQGYMYITQKHICFYAYIPKKHHDVSKTGYLYKRGRSKLNRYWFVLRGDVLAYYTNPAELYFPRNRINLQYALAAEVLESTKKGEEETTFAVTTDERRYLFKADSAASAKEWTRSIQKVIFRTHNEGNSVKISLPIQNVLEIEESSILDLANTVKVRVIDNDETFAIDEYFFSFFNKGQDALNVLRIMVNDNEHHQGTHTGGDRETTPSGHRASPADVGETPHIHENVRATLSPLPAPRARGSSISDVSARSSNELNRKSWDVRRSMDATHTLRGPGHEARKSNHEARRSFHGGPNNTQNKRHSGDGSPQSLKAADSESATLSLEPGTESSAAIQSMEESNASASQILDRSDLFRGPAYQSTDNKLDLQHKNSQDTARSPQAKTTTAAKRYKQPQTPIGTPDFEDGTDTSQANPRLSGSSSALQDIASYPLQKASGLAGFLRSRSKRMGNLLASESMGYYEKVSGMLAGGRKHYNTAEGLETGDQIHGFEDDEDAAKAVENFRDHFAFAETEVLQSSFFASLQRVLPNYGKIYISGRYFCFRSLMPTSKTKVILPMRDIENVNKEKGFRLGYHGLAIVIKGHEELFFEFSKAEFRDECAITVLRILENTKYLEDEDSSSSGIDSEDEAAKAEHDLLQQAREHTDADKQVDVSDIVRAADQDRIPLIFDDPLASFVDFKPSEPLTIVCLTIGSRGDVQPYIALCKELLKEGHKARIATHAEFEPWVRKHGIDFAVVDGNPAELMRICVEHGMFTYGFMKEANSKFRGWLDDVCSSSWRACQGADVLIESPSTMAGIHIAEALEIPYFRAFTMPWTRTRAYPHAFSVLEKKMGGGYNSLTYITFDTIFWTAISGQINKWRRRELGLQGTTQHKMQASLRPFLYNFSPHVVPPPLDWPDWVRVTGYWFLDESDLYEPPADLVAFMAKARADGKKLVYVGFGSIVIDDPAALTRTVVDSILKADVRCVLSKGWSDRLETKDASKPEIPLPAEIFQIQAAPHDWLFKQMDAAVHHGGSGTTGASLRAGIPTIIKPFFGDQFFFAQRVEDMGVGVWLKKVNTSVFSRALWEVTNSQRMIVKAKVLGQKIRKDNGTQVAIQTIYRELDRARTLIKKQAKQDDDQTDDFEEDWTIIEEGEEMDGTHPFEMQQPLAGISQDASQTGGGSLVLGSMVLKGAGVQKRASASAQRD

SEQ ID NO: 7954 - protein, 1229 aa, Phanerochaete carnosa
MASSIHTIYRPLARSRRERVPATRSKSGKLSSVSDAEDEPAPEEPVVLEEELEDDFEQTVDRFTPGPEQGMDSPRMPLSPLPELDFLESNTKSHPSRSGSMATVKLQRRARLAEKLREVFDVPGIQEVIAEMPCWLLRSILLQGYMYLTDSCLCFFAHMPSREDQVLKSGWLSKRATRTKRWIKHWFILKNDVLSWYQSSSDPYFPHGVADLRYAITCEPTGERDIRIRTNQRTIKLSADSVPSRDEWVKAIRKVMFKAQNSGDSVKIAIPYSAIVDVEKSSAMDFSETIEVKAVDKNEAYSIDSYFFAYFHDLPAALEQIRDAVRAYRSAPGGSSSPPVIDTTVSRVPQAAHQLSQSPATLPPVPQVPKSPSHFSFRFTSLLRPLQDSLPLMRGYSAPGYVSRSPENEEYTHVSRKSGSCFVPITTPPAPIQPPSLSGPRSPGLTPTSPNFGHAHTYPPSTSASFTSAPASSLTSKESSTWAVGVPTWLKTGSKKLLSSASFATSLGGLRLTVEHSASAPPATGPGVSEILSTQSHLSESSSGDFGYFSILETPETAMDEETIEKFRTAFAFDEKEKLLGCFQGYIFRLLPVYGRLYISSSYFAFRSSGPLTSRTTMILPIRDILSTQPTKAFRFGHHGLVVIVRGHEELFFEFSDELRRAAFVRLLEKQIEEVRHHAGSGDATQPTTGELDALILEEFGPRTSVLTDAEPVTEPDGMDSSLPAVMFTSTSSTFLTFKPNKSLHFTFLTIGSRGDVQPYIALAKGLMADGHRARIATHGEFKEWVESHGIEFGYVGGDPAELMRICVENGTFTVAFLREGMQKFRGWIDDLLKTSWEACQGTDVLVESPSAMGGIHIAEALRIPYFRAFTMPWSRTRAYPHAFAVPEHRMGGNYNYMTYVLFDQVFWRGTAGQVNRWRRHTLGLPSTSLDKMEPHKVPFLYNFSPVVVPQPLDWPEWIRISGYWFLDDASVSSQKWIPPPDLVEFIANAHKENKKVVYIGFGSIVVSDPKAMTRCVIDAIVQSGVYAILSKGWSDRLVKNVADAGEPPEPLPKQIYPISSIPHDWLFKRVDAACHHGGAGTTGASLRAGIPTIIKPFFGDQYFWADRVEALGVGSAVRKLTVQSLTDALITATTDQKQVQRAKEIGEQIRAENGVATAIEAIYRDLEYARSLIKGLPHEDETDLSTLRGRPTHSRSNSSPGHKSTHSSASSAHGGTISDWSVISDQED

SEQ ID NO: 7955 - protein, 1456 aa, Yarrowia lipolytica
MLSASQFLKHRVSCLPMLNKVESDSTDGDPDDACQHPHDCNIFSVLVNGATDRLEGFFDESDEEDGDEVETPSTTTTAVSPSATMSAPSPTATAPTPHSGTHTPKSPLHSISHCPSFNSVAQALPHSLSPHSLCHTSSHEASRRGSAEQPSRTQSELARRIKTENILNSFHDSLEAAYEKCHGGANPEEHQSNKTEYFQQKLKGFAALDVDEQLIADYPVWLLKNVLIQGHLYITAKHMCFLSYLPRRQNANIRSGTLVKARKRSLREGTRYWCVLKNDSFSYYPDSTDVYFPAGTIDLSEALAAELCDDEGDVTEPESFRIVMPKKSVLFKADSHSAAHEWVKALQKEIFRAHNQGDTVRIVIPLQNIVDLEKTKIFEFATTIKTSVVESNETYAIDEYIFTFFKFGDDVLRTLTENGVEISGGNFSPRQSQLAVGHKHVTESVRDSTLLHASGHHHHFFHSAHHESDGKSNSKSHTSSRSHTPRNLTPQVTGEQPHERDEKRDSKLPRLPKFLRRFKDKVDDKCDDKPTLVPSFLKSRASSRRNSAEGSDRPNLASQRTSSSTLFPSAPPTPGSQPTTPGVHAPGSSTPGGSYGTTTPGTPASADSVSLAGTPGVAAPVGDIEGLNGNPMPAGIAAELKEKRKSGGATSSGAATGATTPGGAAAPGSTGNSSPGTPGGLGGPGAVGAGGPGVMGGAESAPAGTVPQQSHHAGISVVAPHDPAAAAAAADAAAPFTRGPGSGIPEIQDDSDSSDDDHWGHIGTAEVDEDPEQDTFKKKNKRFSTLSKVSDLWSGSTKHYGKHHTERLGDDDDKHLASAEEITESNERFQKRFALGTEERLIASYHCHLHRGGIPTYGKMYVSTNYVTFRSFLRTKTLMIVPLKVVENATKDSGFKFGYSGLVLTIQGYEEIFFEFASASHRDDAEVMLLRQLDIIRPHINDDIKSDDQYMLQSARLCTYEDALKAEANVEMPPVIIDGNLASVLPGLVTPQSKMLFTLLTIGSRGDVQPYISLGKALIEEGHRVRIATHSEFKDWIEGYGIEFKEVAGDPSELMKIMVDHGVFSVSFLRDAASKFRGWINELLASSWEACQGSDVLIESPSAMAGIHIAEALQIPYFRAFTMPWSRTRAYPHAFIVPDQKMGGSYNYLTYVMFDNVFWKGISGQVNRWRKKTLHLPRTNLDHMEQNKVPFLYNVSPAVLPPPVDFPDWIKITGYWFLDEGSKDYTPDDKLCRFMEKARNDGKKLVYIGFGSIVVSDPTALTKSVVESVLKADVRCILNKGWSDRLGKKDAKEPEIPLPEEVLQITNCPHDWLFPQIDACVHHGGSGTTGAGLRAGLPTIIKPFFGDQFFYANRVEDLGAGIHLRKLNVSQFSKALWEATHNERIIAKAAAVGRQIRSENGVISAIQAIYRDLDYARSLVQKKRGYTPTSDKEEETWTLVDDIERQMQDEVEKHNL

SEQ ID NO: 7956 - protein, 1134 aa, Fomitopsis pinicola
MGTVKLQRRSRLAEKLRDVFELQGIHEVVAEMPCWLLRSILLQGYMYLTDSYLCFFAHMPAKEDQVLKSGWLSKRAQRTKRWIRHWFILKNDALSWYQSPADPYFPHGIVDLRYAVSCEPLYEKEIRLRTNQKTIRLSADSAPNRDEWVKAIRRVMFRAQNMGDSVKIAIPYTSIADVDKSSAIDFSETIEVKVMDKDHSSSTDSYFFAYFRDLPGALEQIRDAVRASRGIPVDSDAHFVIDTTVSKPLALPPVASRTQSAPVADQLPKSPSGFKIPSLLRPLQESLPRVRSATPVGQTMPTAEGDDGEEYTHVAKRNSSTFMAVTTSPTGSVSPREPGSPPPEGRFSSPPRPALHTYPPSPSSSYKMADIVPSSSRDSGSWTVGVPSWLRMPSIPSMPSRRTFTNVLGGIRTGEPQSIIEGGSVSEVLSSNAGGGGRTSGGSGCTNDFGYFSILETPATTLDDESIEKFRSSFAFDEKETLLGVFPGYIYRLLPVYGRLYISTNVFCFKSSGPLTTRTRMILPIRDILSTEVSKAFHFGHYGLVIVVRGHEELFFEFNDEERRDAFVSLLERQIEDQRRRSSDPEASSTTEPHNTLILDEAGPRPATQIDVRKVVHEAAMSESLPAVMFNSTSSTFLTFKPDKSLHFTFLTIGSRGDVQPYIALAKGLMKDGHRCRIATHGEFKAWIEAHGIEFGYVGGDPAELMRICVENGTFTVAFLKEGMLKFRGWIDDLLKTSWDACQGTDVLVESPSAMSGYHIAEALGIPYFRAFTMTWTRTRAYPHAFAVPEHKMGGNYNYMSYVLFDQVFWRATAGQINRWRRNTLGLGGTSLDKMEPHKIPFLYNFSPVIVPPPLDWPEWIHVTGYWFLDDADVSSKKWSPPQDLIDFLDSARKAQKKVVYIGFGSIVVSDPKSMTRCVIEAIVRSGVYAILSKGWSDRLVKDATEVSDPEEPLPKQIYPIASVPHDWLFKRVDAACHHGGAGTTGASLRGGIPTIIKPFFGDQFFWADRVEALGIGTAVRKLTVESLTQALITATTDQKQITRARYVGEKIRAEDGVETAIEAIYRDLEYARSLVKDPVAGDLHEDTPDAEHATIRESRQPLSPEPSGARSASSSVSSAHDAPSDWSVISDQE

SEQ ID NO: 7957 - protein, 1581 aa, Melanopsichium pennsylvanicum
MSIASPNSPPRPFSSSRDEHRSPSTNDTQPSAANLDPFVTDDPDDEPHIPTQVTDQYGTPPFPTSPRLDPSSPRNFSTISSLAGSRELGRPVLEPITQIFTASPSVPALQSGASMSLLPDDTLADETAPDGMEVAPTDVTFHAKPQGLMQMLSLVGSTFFEADREGFTEDEAEELDRQLAPTNRAERGRECPESAPMIEGQQQPQDLRRYSFDPTSAFSAKGRLQALARDDGSDDGFTPQGGRSPLDASVLTIGPSRPERSSLAQSDILGLSRDPTATKGGRRPSNLRSQLHNVESASTYASTSRLGDPTDARQTPSSPLQEDSIDSPGLPSACQGSKGHRSTAHLLSQRRLDPLLIRPYPDPHPSGEAQADKSELDRDRLIVQLKEVFQLDAAEILLLAQPCWLFRSLLLQGHLYLTSGHVCFYAYLPSRDEKVIKTGMLGKRTRRTHRFSKHWASLKGGKLSWFDSDRDPYFPQGHIDLRKVSAIEPSQNHKERFKVTTPARRFTFLAEDEHSRDAWIVALQKQTFRAQNQGDSVRISIPLETIMNVETTLSVDGTEMVCITVVDEAGDFSIDEYYFLHLTKPSAFISSLNSVLDGAARGSGSSPQSAEQDLNFSRLSIRDSTGAAHASALSRKSLEEVPTLSQVHVSARAPDGDAGANMCTGKPLGVAPSTAAQEKQLKSDEIQDGPQALGPTTATAIAVPTSIRRKPQDAPTEAVLSTTPRAAMLNRLSMESAHTYPPSPSISDPSSSFDQVQREAERGWAIPNWLKSAPAKVLGRAADGSSSAPQGKTTANVTSCKRRRKVVERWSDDKTDSASREASSATDTEDDLLSQSIHSARSNYSMLDANEAEDEQVDNTNVAAEFRDTFGIFEEEGLIGHTHAYLYRVLPVAGRFFVSEHHLAFRSSGIAAKTVGRTLMLVPLQDVISAAKHVAFRPGHHGMVINISGHEELFLEISSGHRRDELLSLIEYQLELERGGRGSRASREAVTRERSNALVLRDLSERITDGPATASLTSSADSTMLSPIQSGLRNSGSLSQLGDGSHILSFAPATPLTFTMLTIGSRGDVQPYIALAKALQADGHRVRIATHAEFGDWIMGHDIEFSEIGGDPAELMRICVENGTFTVSFLREGVTRFRDWLDDLLASAWRACQGSDVIIECPSAIAGIHVAEALQVPYFRAFTMPWTRTRAYPHAFAVPNKKAGGNYNYMSYVIFDQMFWRASSFQINRWRKNLLALKPTSFDKLEQHKVPFIYNFSPSLVPRPLDWFEWIHVTGFWFLDNPDNSSSKKWEPPADLVAFIQGARERSRKLVYIGWGSIVVPDAETMTRCVLQAVQKAGVCAILSKGWSDRLSSDPKKGTASLDPSLVQDVFQVSSVPHDWLFPQIDAACHHGGAGTLGASLRAGLPTVVKPYFGDQFFWGQQIESLGVGSCVRRLTADNLAEALVKATSNVKQIEKARKLGEQIRGEDGLGNAVKAIYRDLDYARSLVKRNTRLVTESSAPNAARETVIGTEADKTAAGAVGNEEAKPGVETKTTKQQLGSSDLSPIEDGEDGGISDEWSDIGGGPLSPSREEHNASLVFS

SEQ ID NO: 7958 - protein, 255 aa, Thalassiosira pseudonana
MPVVESDNRKESSAGFGGQDTLNTLKSFLSSGSKPIYLGFGSMFSKTPEYMTLWTVRALRHSGQRGIILGGWAKMSSRFLQDAEPELVQYAKDNILFVPNAPHEWLFPQVSLIVHHGGAGTTHASLRAGVPVIITPVLGDQFDNSKLVNALKVGYGFSQQLQRIHWQELGDAITRVLADEGNARRVAKVGCMLQMQNGADGAADEVLHFWNDFVLTGIFSQLFPGDVAKKTKTNFSSIASAVVLVVFAVSAIALV

SEQ ID NO: 7959 - protein, 428 aa, Haliangium ochraceum
MARILIMTYGTRGDIEPFLALALGLKDAGHDVTLATAEQFGDWVSDFGIDYAPITNASLDVIHSEDGKTMLEGGAGLFARIAAGARLARQSRAINEQLCRDAWRAAEATRPELILYHPKIMAAPHIAEKLAIPAILAALQPMLVPTAAFPVTGLPRLPVPGYNRFSYRFVNLSYGALKGSVNRFRRELLGLAPVRRAAEVLRPPSARASKVLHGLSPQVIPRPDDWPNYAIMSGYWPLPPDPAFTPPDELLRFLDAGPPPVYVGFGSMVSKDPEALAELVVEALRLAGVRGVLGAGWAGLAADADGVVAVRDIPYGWLFPQMAAVVHHGGAGTTAAGFRAGVPSVICPFFGDQPGWAAASVALGVGAPPVPRKRLSAERLAASIRVATSDQTLKRNAKRLAAALDAEDGIAVAIAEIEDTLQQAASAS

SEQ ID NO: 7960 - protein, 1476 aa, Hericium alpestre
MSRLAKSQIIPSRQPTACASPAGRSSQDESHNDADKSPSTSPRSKIVKRVMERTSEKLGRSKSTEAKSSDMSKSESFAGHRPILSRSRKGKDKQDGFEARNGDEIAGPQHRAQESPARSTPLSEPNDESPFIRPPSPSQHPRRPSLNRFGLETSMRAGTQTLIQALQALPWAEDQDNEDEAINHGNLSPAESDSDDEVKQSRGLSSSIHTIYRPVARSRRAESSFRLPPVRDEAETHPNPEDIAEAAQRAGFAMSDEEIEDDDFEVATPGLSSSPIRQSPTQEEEGDAALTPVMQSVAFRVHPERTGSLATVKTVRLDRRARLAEKLADIFDLSGINEVISEMPCWLLRSILLQGYIYLTNSYLCFFAHMPAREDQVLKSGSMYKKAQRTKRWIRHWFILKNDVLSWYQSSSDPYFPHGVVDLRYAITCDAANEKDIRLRTNNKTIHLSAESLPSRDEWIKAIRKVIFKAQNMGDCVKIAIPYSAIVDVDRSHAMDFSETVEVKVVDGDDQLSIDSYFFAYFHDLPAALEQIRDAVAAARNFISSPNHPQALRIDTTVPHSASVPRLGSSSRLPSVPESTPSRLPTFRLSTLLRPFSDSLPIGRSTSAPEPIEDSNEEFTHVQKRADSSFVPITTSPRSMDASVFDSLSPPSSVTGLPPTDSPEGPGNEESTPTNTKVGYTYPPSTSLQETSLAASRESSSWNVGVPSWLKAASSRRILGVSPSAPAGLNQSATAATDGRGVTEIYSSTLSTSTGKSSNGGNELGYSILEAPGVSMDEEATDKFKAAFAFDDKEKLLGYFPGYLFRLLPVYGRLYISTNYLSFKSSTPLAGKTRMILPLRDLLAVEISKAFRFGHYGLVIIIKGHEELFFEFNQDDRRAAFRLLLDQQLENVRKRQANGETTGQSKGQLAHGFGAAVMFTSTSSTFLTFKPKESLHFTFLTIGSRGDVQPYIALAKGLMADGHRVRIATHGEFQNWVESHGIEFGYVGGDPAELMRICVENGTFTVAFLREGMQKFRGWIDDLLKTSWEACQNTDVLVESPSAMAGYHIAEALRIPYFKAFTMVWSRTRAYPHAFAVPERKMGGSYNYMTYVMFDQIFWRGTAGQINRWRRNTLRLPSTSLDKMEPHKIPFLYNFSPIVVPPPLDWPEWIRVTGYWFLDDADVSAQKWTPPPDLLQFIDNARQLGKKVVYIGFGSIVVSDPKGMTRCVIDAIVRSGVHAILSKGWSDRLTKNVAEASQLEEALPEQIYQISSIPHDWLFRRVDAACHHGGAGTTGASLRAGIPTIIKPFFGDQFFWADRVEALGIGTGVRKLTVESLSDALVSATTDIKQIDRAKMVGENIRAENGVAIAIEAIYRDMDYARSLIKAKRAVDDLSEAEDATIRDNDKRMSSSSRADIRSGDSSAGGAPSEDWSVVSDQDEPSSASRSVSRRASDARQSWRRSGLTAAMLSVLPDALTTGHRRSRSASSLSASNSNA

SEQ ID NO: 7961 - protein, 427 aa, Cyanothece sp.
MRITILTTGSRGDVQPLIALGQGLKQAGYRVKIATHDTFQVMVQHHGLEFAAIAGDVQALMASEAGQQMLKSKNPIYLIQQYARMVKPLVIQAMMDSWAACQDSDAIIFTATAVWGYDIAEAFGIPCFFASLMPQTANPDFPYPSVSPDLQLGRVLNQWSYPLLMEAFGTVFRQPLNQFRRSQLQLPPIAFGTIYRRIERTSTPVLYGYSPIVVPKPQNWSDHHHVTGYWFLESTTDWQASQALLDFLTAGSPPVYIGFGSMGGGDATQTQMILDALKQTGQRGILLTGWGGIAQTNLPDDVLLLNSVPHSWLFPKMAAIVHHGGAGTTAAALRAGVPSVVVPFFGDQPFWGDRVMKLGTSPSPIPKAQLTTERLAAAMTTMVTNPVMQQQAKAVGATIRAENGVQQAISVIERDLATSKYRFAQCV

SEQ ID NO: 7962 - protein, 1496 aa, Leucoagaricus sp.
MSHHSSFQPLFHDPATAPEGDTSPQALGMPLSHSLSDDPKDPHTPSRVKRISNAVEKTVDRLSKSVSAKMPHPPATQSPSPSSHRRIFSLSRRSKGQQPDSGSASSSATPSASRLLSVQPTLSNSTVTPNDDCPFVRPPSPPVRPSLSSFRGEGSMRMGTQTLIQALQALPWIDPDNDDEGSGQEQDTTGSESEDDENQRVDRLASSIHAIHRPLARSRRRDIPRYNRQDDSQPVAEEPETYLSDEDVEQDFEEPKSPETRPPLTQHSQSLPPLGNHNITSSAVVPFKYANIRTGSMATIRLQRRARLAEKLRDVFELEGIKEVLAEMPCWLLRSVLLQGYMYLTNSYLCFFAHMPSREDQILKSGSLNKRAQRTKRWVKHWFVLKNDALSWYQSSSDPYFPHGIIDLRYAISCEPVGEREFRLRTSQKTVVISADSVPSREEWVKAIRKVIFKAQNMGDTVKIAIPYSAILEVERSSAMDFSETIEVKVFDKEGNYSVDSYFFAYFHNLSAALEQIRDAVRNVRSLPDQEQAQVLDTTVARPSIATPIPERPNTTPDVGATKSSFSSFRISSLLRPISETISLARSSGTTPTSELSIKSEDFTHITRQTNSFVPVTESPKPIEPPPSGTSSPPTLEDSQATTTPQQQQQQAPTAPDHTYPPSTSRQSVVPDLPSFRSSSWGVGVPSWLKTRRYFGSAISPPQSPSANAAVKEVYSPQLASSSSGPVSKTSGGGSGWGDMAFSILETPNVPVDADMTEKFRAAFAYDEKETLLGYFPGYIFRLLPVFGRLYISTNYFCFKSSGPLTARTRMTLPIRDILAVQKSRATRFGHHGLVVIVKGHEELFFEFGAEDKRDSFILLLERQMDDVRRRFATGETNSDNSPGKCEALILEEFERKDSTSSMELASTSTAATGPNVPENMTDSLPAVMFTSASSTFLTFKPSKPLHFTFLTIGSRGDVQPYIALAEGLIADGHKCRIATHGEFKEWIESHGIEFGFVGGDPAELLRICVENGTFTVSFLKEGLQKFRGWVDDLLKTSWEACQGTDVLVESPSAMGGYHIAEALAIPYFRAFTMTWTRTRAYPHAFAVPEHKMGGSYNYMSYVMFDQVFWRATSGQINRWRRNILHLPPTSLDRMEPYKIPFLYNFSPHIVPPPLDWPEWIRVTGYWFLDEADVSAKRWTPPEDLVQFIDTAHHNGKKVVYIGFGSIVVSDPKAMTKCVIEAVIQSGVYAILSKGWSDRLHVKVGDTSEPEEPLPPQIYAIQSIPHDWLFRRIDAACHHGGAGTTGASLRAGIPTIIRPFFGDQFFWADRVEALGVGSGVRKLTVASLTEALITATHDQKQADRARLIGEQIRSENGVATAIESIYRDLEYARSLIKHTAVVDPEEDADNEHSTIRNRDASLPNNFSPGSYSGYSSSGSVRGAPSEDWSVISDQEDQERESRSLESFRTSEGKGTKDSPAKRADFAHSPVLRVNDLAMYLRLLMPPFNLTCFALTS

SEQ ID NO: 7963 - protein, 1564 aa, Pyricularia grisea
MASSTSDQKPEPGLNVPLRSPAPDTASPPLVSPHLPRRASSHHNRNPPTSVLSPNSEKPSRQSEDDPKKRIRKLQKKRHNGAHSPTMEIPERLRESDPEDEDDDTRRPPFTMNQSIFGLIAAAGSAVDFNDRFEGASSDEDDDGADGDHELPFPRDRRRNMAQTAILRRSRAPDESLEVEKKRRKGSGHKLLRSLPQISLPKRLSSLSKKSKSTKSKEPQINEEEEAEESQPSPENSSPTIESSRNDGRLPPVMSRILEARAELSLSRPSLDLDRIYGSNSPTAEGGPSALAIKLKEIFEFDQVEAVMDEYPCWLLQSVLLQGYLYITSNHICFYAYLPKKANEVVKSGYLSKSGKRNPKYNRYWFRLKGDVLAYYRDPSNLYFPSGQIDLRYGISATVTDKDKDGLNFTVVTHQRSYHFRADSAPSAGEWVKSLQRVIFRSHNEGDSVKISLPIRNVMDVEEMQVVQFAETCKIRVIDNDETYAIDEYFFSFFSFGKEAINVIKAMVDQRQDGQNNDSRGSDDDSPYVEPPSKSSSISGGRDRPPKLSKINDNVRATLAPMSPTSPTNPSPRASGDFSRSSFDALRNFGRRSLDLDSAVRDESQVRRSFSGHRHARSRSRPRLSEHEPIPEKHGSSDSYIQSSTEDPSLASISGMIVSGSEDQSASQILKGSDVFHSPTIRRDGSGSRKGDNDDKSSDKLTSKARPQAGNGHSPDFKISDKPSRHSEGQANTMVSLPARGAGALAGYLNRPLSPFRRMSNLLATESMGYVEKVSGMWKGGHRHYDEAAALKTDDELAEDEDEEKVATSRERFRQHFALPESEKLVATYFGHMIRVLPLYGKIYISDRSFCFRSLLPGTRTKLILPLKDVENGHKEKGFRFGYSGLVVVIKGHEELFFEFGQAEVRDDCAITLLQQLESTRYLQESGMLGQDEKEDAENAVAERDALQSARQEERPTHEIPLPKQTSVVSDAPTILFDDPKASFLNFKPPNPLRITCLTIGSRGDVQPYIALAKGLLREGHEVRIATHAEFEPWIRSHGIDFRKVEGDPGELMQLCIENGTFTWQFLKVAASKFRGWLDELLSSCWQACQGSDLLIESPSAMAGIHIAEALQIPYFRAFTMPWTRTRAYPHAFVMPEHKMGGAYNYVTYVMFDNMFWKMTAQQINRWRNVELGIPNTSLEKMQPNKVPFLYNFSPYVVPPPLDYSDWIRVTGYWFLDEGTPRKAAAEIEAGDESEEKPTDQKDGDKNVASGSNWTPPPELADFIEKARADKKKLVYVGFGSIIVNDPVKLTQEVIDAVIKSDVRCILSKGWSDRMSTGSNATDPKPSQDGEQAETDQQQPVEKKEEPKLPDEILQIKSAPHDWLFAQVDAVAHHGGSGTTGASLRAGVPTIIRPFFGDQFFFGSRVEDLGVGICVRKWGTNAFARALWEATNSERMIVKARVLGEQIRKENGVETAIQCIYRDMEYAKSLIKAKANKNTKQQPSKHEGQAGEVHDDEGSDDDTEEWTFVGGNDPGEGGAEFPDAAYRRQESAKSGDAAVGLGLGIGASSSGGGKALGSKVLSGA

SEQ ID NO: 7964 - protein, 1486 aa, Fonsecaea multimorphosa
MSNLESPPSKKSGLRKLHIRNLNRLPSSHIPSRLRLGDDAQEDVTAPNRGSNMPAQYMNQSIFSMIAAAGSRTDFNTRFDESSDSEDEISEEQEQTAGDKGSLPVAPETGSSETQSVATKDEKSTGEKKSKRLSSQRLVQSLPRLSGRSLRKKEDTPRKDPSPESDDTSESSRSNPRDAPVLSRLITAEAQFQESAEGQDQMLESPTAMRSRSRGESTPQTLLATRLMEIFGFEVPEPVVAEYPCWLLQSVLLQGYLYITKQHICFYAYLPKKSHTVVKTGNLSKKGRTTSKYKRYWFSLKGDVLSYYSDASNLYFPSGNIDLRYGISANLSIDKEKGKSKECKDFSVTTDHRTYHFRADTASSAKEWVQTLQKTIFRSHNDGDSVKISLPVENIIDFEESPVVEFAETVKIRVIESEDSYAIDEYFFSFFSFGQDALNVLGSLITEAPARRTSEDVLSPTRKVEPLSSPRPRATSNQHSSDVIPGSPRAQSSPPLKDSVRATLLPFSVGNDGRMSPRMSGEFPRGNSPSRSSHEFAGEYGRASFDRGRRSGSTSRLEATNSKRTTRSPLARHDASEDSYVQSIDKETDSSTAPLSPRAEAQMSASQILTRSDVFHQPAIHRMETLASMSTEPTRSDVGTILSSSPQRGDTHPIPIRSAHEPPTDRRATVANEFLSAELEPGKNYVRNSSSPTLQDLVKAGSYPLQRAGAFADYLKSRSSSMRKLLATESMSYLEKVSGMWAGSRKHYGENEGVVPDDRGIDPEDEEANVGHGDRFRAHFALPATEKLQATYFGFLHRVLPLYGKIYISNRKFCFRSLLPGTRTKLVLPLKDIENVDKEKGFRFGYHGLVLVIRGHEELFFEFSSGEHRDDCTVTLLHSLETARYMAESGVLAKADEDDAEIAKEEHRRLQEARRTSTAGDHALVLPDTTEAIYSHKDEEPSGPVLFDEPRASIINLSKPSASLRITCLTIGSRGDVQPYIALCKGLLAEGHRPRIATHVEFGPWIQKHGIDFRPVDGDPAELMRICVENGMFTYSFLREASAKFRTWIDELLTSAWAACQESDLLIESPSAMAGIHIAEALGIPYFRAFTMPWTRTRAYPHAFAVPEHKIGGAYNYYSYVMFDNVFWKAIAGQVNRWRKKELGLRSTNLDKMQPNKVPFLYNFSPHVVAPPLDYSDWVRVTGYWFLDEASDWTPPTELTDFIKKARDDKKKLVYIGFGSIVVSDPAALTKTVVDSVLKADVRCILSKGWSDRLGDPQAVKAEVPLPPDIFQIKSAPHDWLFRQIDAACHHGGAGTTGASLRAGLPTVVKPFFGDQFFFGSRVEDLGVGICLKKVNVSLFSRALWEAAHSERMIVKARLLGEQIRQENGVQTAIHAIYRDLEYARSLVKARAAIQQQGAAAAAGGATGLTAIDLLDEGGDIEESWTFIGDESDPNIQRRLQEWDTTAAGTGGHSPMRGRAPRVSLDRAKLGAMQGVEPVRKASVKR

SEQ ID NO: 7965 - protein, 1449 aa, Byssochlamys spectabilis
MQRLDVEDSIKKRMGRRLSFRSRSIHRMPSHQVPDRFKDGDDAQDDFTAPPKGIGGREYMHQSIFSMIAAAGSKTDFHGRFDDPSDSDGEGEGIAEESSTSKGDKGRDAKSPTKKRETENTPSSKDSVKKDLLEDRGRIHRRKLSDHRLLRSVPKLQSRHTKGKESVGKNELGACDELLPASPPRRPRSLTPRAAPVLSRMIEAEARFGDPPSHRQETQKAAEDRSPTRQRADSAPSSLLSTRLMEIFGFDKPEKVMGEYACWLLQSVMLQGYMYITEGHVCFYAYLPKKSNTTVKSGYLSKRGRQNPKYNRYWCSLKGDVLSYYADPSNLYFPSGHVDLRYGISAALIEQKDKGKDVKDFTVTTDQRTYYFRADSAPSAKEWVRTLQKVIFRSHNEGDSVKISLPIENVIDIEENPMIEFAETVKVRVVESGDTYAIDEYFFSFFNFGKDAFNVLKDLVKNTATQTNSQGLPDATSGDASVERPQGQTLDAPFHSPRSGRSSPRFNEPVKSTLLSRSPDAGKGHLRSKSMESADPLSPARAYLDRSPPDNKASSDSFVHSIEQGTESSAVLQSITGTAESASQILNRSDVFQSPTINRLRVPSDADATGRRRSDETARSASARAKARAGTGVNKEDQEVREAASDSENEVNSRSRYSTSAPTLQELVKAGTYPLQRAAGLAGYLKNRSKRMSTLLATESMGYIEKVSGMWAGGRRHYGEGEGILPDDQLVDPEDEERGCGHGDRFRAHFALPPTEKLQATYFGYLHRLLPLYGKVYISNRKFCFRSLLPGTRTKMILPLRDIENVEKEKGFRFGYHGLVIIIRGHEELFFEFNASDVRDDCAVTLHQSLESIKFLAESGILAQEDKEEAEAAKAEHQMLQEARLDVSADNEEGSRALSPPESPEVHPIFDDPRASIINFKPTESLRITCLTIGSRGDVQPYIALCKGLLAEGHRPRIATHAEFGPWVRKHGIDFAPIDGDPAELMRICVENGMFTYSFLKEASLKFRGWIDDLLSSAWASCQDSDLLIESPSAMAGIHIAEALRIPYFRAFTMPWSRTRAYPHAFAVPEHKMGGAYNYITYVMFDNVFWKAIAGQVNRWRKNELGLRGTNLDKMQPNKVPFLYNFSPSVVPPPLDFPDWIRVTGYWFLNEGDDWQAPRELTSFIQRARADGKKLVYIGFGSIVVSDPAALTRTVVESVQKADVRCVLSKGWSDRLGDPASAKSEIPLPPEIHQIQSAPHDWLFSQMDAVAHHGGAGTTGASLRAGVPTIVKPFFGDQFFFGTRIEDLGVGICMKKLNVSVFSRALWEATHSERMIVKAKMLGEQIRSEDGVSTAIQAIYRDLEYAKTLARQRSIASATPFSPVAKKEEITEPPLDDDVADSEEWTFVGDDTDIDISKRMRDREDADIDLPPPALCSHGSSSPARTVQSVLDASDASIGWKRDDMRAQA

SEQ ID NO: 7966 - protein, 1482 aa, Piloderma croceum
MSDHDSLKPVVHDYALTNQPSQPAVPMMKHADQDEEADGSSSPRKRITRAVGKSVDNLTRSLSGRSTPQQRQTAASPPRRLFSLNRKGKPKELINESLSPDSDNSNAQGRYVSPSPSSRPTSPIISGASDDSPFIRPQSPSAPAYPIRPSLQAFRGDGSMRAGTQTLIQALQAIPWAEDSDNDEEVMPQRLSTALESDSSDEEDTLGHLASSIHTIHRPVARSRRADAPPSPALGLQAPSMGIHGEVASESESEENLVSEELEAEDFERTPRPSGSVPDYVQELSSSPVGTPGGSNDLPRRTTMARSGSMATVRLQRRAKLAEKLKDVFELKDIDEVWAEMPCWLLRSVLLQGYMYLTNSYLCFFAHMPTREDQILKSGSLNKKAQRTKRWIKHWFVLKNDALSWYQSSSDPYFPHGIVDLRYAISCDPVNEKGIRLRTNQKTISLSADSVPSRGEWVKAIRRVIFKTQNMGDSVKIAIPYSAVLDVEKSAAMDFSETIEVKVVDKEEAFSVDSYFFAYFHDLPDALDQIRDAVRASRVLPPLSSPQAVLDTTAARPPLAPVIPMDRAQSLPAVDLASKTTSGFRLTSLLRPFHDNARPMSSPSPEHLDQGEDFTHISKRSGASFVPFTSSPKSQEARLPSSEPRPLVGASASNLTPTPSNIEHTYPPSTPTNDLPSMSWNVGVPSWLKGSSRRVLGSSSSAGITYSTPLVASTSLGGVSEVYSSTTLSSSTTRSRCAPSELGYSVLETPEIAIDQEMTDKFRTVFAFDDKEVLLGYFSGYIYSLLPVYGRLFISTNYFCFKSSGPLTSRTRMMLPIRDILAVENTRATRFGHHGLIVIIKGHEELFFEFGLEDRRSAFVTLLERQMEVVQRPQVASEVPILSPGKRDALLLEEFEAKTSDSTDADPRPAPDGMTDSLPAIMFTSASSTFLTFKPKESLHFTFLTIGSRGDVQPYIALAKALLADGHRVKIATHGEFKEWIEAHGIEYGYVGGDPAELMRICVENGTFTLAFMKEGLLKFRGWLDDLLATSWEACQGTDVLIESPSAMGGYHIAEALGIPYFRAFTMTWSRTRAYPHAFAVPERKMGGSYNYMSYVMFDQVFWRATSGQINRWRRNVLHLASTSLDKMEPHKIPFLYNFSPIVVPPPLDWPEWIRITGYWFLDDADVGSKKWTPPSDLEIFIDSAHKVGKKVVYIGFGSIVVSDPKAMTRTIVEAIVHSGVHAVLSKGWSDRLQVKPNGEVAEPEEPLPPQIFRISSVPHDWLFRRIDAACHHGGAGTTGASLRAGIPTIIKPFFGDQFFWADRVEALGVGSGVRKLTVESLTDALRAATTDIKQIDRAKLIGEQIRAENGPATAAEAIYRDLEYARSLIKRAIHDDLLEDVIVDEDATIRDYERRPSSSHSGYSSSGSGPGASSEDWSVVSDQEDRRSSMGSRRSRSDGPVDRPSTFKRNSLAAAVMSVLPDALHAVPSHRRTGSVTSSTP

SEQ ID NO: 7967 - protein, 1133 aa, Pseudogymnoascus sp.
WVKALQKIIFRSHNDGDSVKISLPIENVIDVEDSPVIEFAETCKIRVIDNDETYAIDEYFFSFFSFGKQALTVLRTLVPVIEFAETCKIRVIDNDETYAIDEYFFSFFSFGKQALTVLRTLVSDSAAKQIPEDLLVQPQGNSGGNSPKPQGNSGGNSPKVSSCRPSLTISTRESKPHPNPAKATTSGLEESVKATLSPMMSSPLHVHSPRASGEFSRTSFDINQRSSSQTRASRRSMDVSRLNLDGNGRNGSPSNDRRSFSRNRAPEKRNSEKQDSSDSYVHSMEESSAAAQSASEDATGSASQILRGSEGFFQPTIHRSASASRRRDDYQLPGGPLLPPTVPHHAATMDVFERPKLIQGDNASTPSLQTLAKAGAYPLQRAAGFANYLNRHSKRMSNLLATESMGYVEKVSGMWKGGKKHYDEPLSQGLEDDTDDEGGQSDGAENRFQSHFALPAGEKLQAAYFGYFHRVLPLYGKIYISNRSFCFRSLLPGSRTKLILPLKDIENVDKEKGFRFGYSGLVVVVKGHEELFFEFGQPDTRDDCCVTLLQNLETIRYLKESGLLTQEEEESAAWAVAEHKALQEARHESRQHGHDLELPTTAEGASTDTAPIMFDDPRASILNFKPTESLRITCLTIGSRGDVQPYIALCKGFIAEGHRPKIATHVEFKDWIEGHGIEFAPVGGDPAELMRICVENGMFTYSFLKEASTNFRGWIDDLLSSSWLACQNSDVLIESPSAMAGIHIAEALGIPYFRAFTMPWTRTRAYPHAFAVPEHKMGGAYNYITYVMFENVFWKAIAGQINRWRKKELSLPRTSLEKMQPNKVPFLYNFSPSVVVPPLDYSDWIRVTGYWFLDEGTDYTPPKELSDFIAKARADGKKLVYIGFGSIVVSDSAALTKTVVNSVLKADVRCILSKGWSDRLDKVGATEPEVPLPEDILQIKSAPHDWLFTQVDAVTHHGGSGTTGASLRAGKPTIIKPFFGDQFFYGSRVEDLGVGIYLRKLNVSVFARALWEATHSERIIAKAKLLGEQIRSENGVDTAIQCIYRDMEYANSLIKRKSGSHEGLAEDIEESWTFIGDDNDPELMSRIHAWDPRVVLAHSRDMSEPHLKDVAESPVPTPRSETPLPSDKEAGSK

SEQ ID NO: 7968 - protein, 1432 aa, Glarea lozoyensis
MASEGDNKKRVTRKLTKKRKEGHQVTMEIPERFRDGDDAEEDHTTLAGGNAYMNQSVFGMIAAAGSQVDFNARFDTQSSDEEEDSTEQPSQESTGSNLHVEKTRQDKTAKPDKHRRKFSENRLLRSLPRLGTKSKSKIKSSSPHSPSSPAHESPSDLVTPSIQLPRTASRDAPVMSRMLNAKAELSMRPSFDMPRSDTEGEDNGQVRSSSLAKRLMEIFNFDKPEDVIEEYPCWLLKSVLLQGYMYITTKHICFYAYLPKKSNEVVKSGYLSKSGKRNPKYNRYWFRLKGDVLSYYSDPSELYFPAGNIDLRYGITANVADKSSGKDAAHFTVVTHQRVFNFKADSIPSAKEWVKSLQKIIFRSHNDGDSVKISLPIENIMDIEDSQIVDFADTCKIRVIDNDETFAIDEYFFSFFSFGKEALNVLRILVEDTTAKQIPEDLLSPALPKDERASPRGSTSRRSSANLLREGRPSMTLAIPPETPVLEESVRATLSPIGVVQSPRASVDISRASSDAYRRSMDLTKFGRRSVDLSRMTMDSGGRRSMSASRRSFSRNRLPSEKQGSSDSYVHSLEEHGSSAAIPSASDDTQASASQILRGSDVFLSPTIQRSSSASQRRDVDSQRKVPLTHSPTRSNTMNRRPRPEHALTTGSLIGPSSQQSDQNASGPSLQNLVKAGAYPLQRAAGFAGYLNRHSKRMSTLLATESMGYVEKVSGMWKGGKKHYDEPEGLIADGEPHVEGNDEQAAISGDRFRDHFALPETEKLQAAYFGYLHRVLPLYGKIYISDRSFCFRSLLPGTRTKLILPLKDIENVDKEKGFRFGYSGLVVVIRGHEEIFFEFSQPDIRDDCAITLLQNLEGMKFLQESGLLSMEEKESAQNASAEHKALQKARLEENPSHELKLPQSAEESKSEAPPIMFDDPRASILNFKPTESLRITCLTIGSRGDVQPYIALCKGLMAEGHKPKIATHIEFKDWVESHGIAFEPVAGDPAELMRICVEYGMFTYSFLREASSKFRGWIDGLLSTSWKACQGSDVLIESPSAMAGIHIAEALEIPYFRAFTMPWTRTRAYPHAFAVPEYKLGGSYNYMTYVMFDNVFWKSIAGQVNRWRKNELGLQSTSLEKMQPNKVPFLYNFSPSVVPPPLDFSDWIRVTGYWFLDEGGQDFQPDKDLMDFIAKARSDGKKLVYIGFGSIVVQDSAALTRTVVDSVVKADVRCILSKGWSDRLEKKDANKIEVKLPVEIYPIKQVPHDWLFSQIDAAVHHGGAGTTGASLRAGIPTIIRPFFGDQYFFGSRVEDMGVGIAVKKINVSVFARALWEATNSERMIIKARVLGETIRSENGVNTAIQSIYRDMEYAKSLIKSRKGKPSDDNIEDSEESWTFIGDENDPELVKRIHNWDSVAQLGTLNRKNEGLAGSDESGSKTDTEIMMESTST

SEQ ID NO: 7969 - protein, 1749 aa, Grosmannia clavigera
MPPPTSSTPDPSSRAALSPASPASPASPASPASPASPPPKLSATTLTTPAVASFDRRLHHRRNASSSTTPASSPAVAAAVSVFRSRHSEDDAVHHGLSKMLQKRRRDGHQHMSTMDFPERLKVATDGAEDEEVLRPNGQSNGVFMNLNQSIFGLIAAAGSTVNFNNRFEGQSSDEGDDEDDEDTDKNEADDNSRSPALDGTSESQRAAWLARKRHDGDSSADRTDKKDKRRSKDLSQSNLFSRISGGSSNVSLADKPGDRHSRLSENRLLRSLPSLKTRLSVRHSRKTSKEAGTVPSTEKQTGSDSSRRRSRIDEEDEEQDDRAPTPTPATITRTGAPAPAVTYVVSPVDSSASVAVNDDGLSASVLALPRGERSNSVRSIAPVMSRMLEAKAELAARPSFDFDRRSSDKSRTANNDSNDTDVDSDDAIGSSALARKLMEIFDFEKPEEVIEEYPCWLLQSVLLQGYMYITANHICFYAYLPKKANEVSKSGYLAKSGKRNPKYNRYWFRLKGDVLAYYRDPSNLYFPHGQIDLRYGISATVTDRDKDGVHFQVVTHHRTYYFRADSAPSAKEWVKSLQRVIFRSHNEGDSVKISLPIANVIDVEETQTMVEFADTCKIRVIDNDETYAIDEYFFSFFDYGKDAVRVLRILIEDANQQQQSPKRGRDHTDESLALRLQMRSTASPQQSADDADESASASAPERGPAAPGASGSFNGNIPAVASASDSRILKATKLHSSVRATLSPVSPPTSPRVSGEFPRSSFDALRTSFSGRRSLDTSVAQLGEAPPRRSFSDYSRRSLSTDRDRRPARSSRQQQQRHPLAGSTDSMVPLSSMDPSVASLSGLVVSSTENDQSSASQILHGSEIFKGPTIVHRSASASRRREGKRASWQPGRTSGSARHFDSGRVGDSEHASSADSQTLPSDIATGGGAITPGGTASLQRLAKMGSYPLQRAGAYAGWLNQQSRRMSSLLATESMGYVEKVSGMWKGGHRHYNEGPGPGSGLMRMGEELDDDTAGMGGAGGEGEAPDLAVINERFRAHFALPETERLQATYFGYLMRVLPLYGKIYISDRSFCFRSLLPGTRTKLILPLRDIENVTKEKGFRFGFSGLVVVIRGHEELFFEFGQAEMRDDCSVTLLRGFESARYLRESGLLNEDEKAGAQTALAERDALQEARQASREGEEGGGENDNDSTPAAANVMRLTESPTTILFDDPRASFLNFKPAEPLRITCLTIGSRGDVQPYIALGKGLQADGHHVRIATHPEFEDWIRSHGLDYGRVEGDPGELMRICIENGTFTLQFLREANSKMRTWLDELLASAWTACQDAELLIESPSAMAGIHIAERLQIPYFRAFTMPWTRTRAYPHAFIMPEHKMGGAYNYITYVMFDNIFWKATASQINRWRNKMLGLPNTTLEKMQPNKVPFLYNFSSSVVPPPLDYSDWIRVTGYWFLDEGKKEGKDGKDKKDETPPWSPPQDLVDFIAKARQDKKKLVYVGFGSILVPDPAKMTQEVIDAVLKADVRCVLSKGWSDRLAGDKDKADDDDHTRVEVPLPPELFQIKSAPHDWLFAQMDAAAHHGGSGTTGASLRAGIPTIIRPFFGDQFFFGGRVEDLGVGICLKKWGATSFARALWEAANSGRMIKKAAALGEQIRQENGVDTAIQCIYRDMEYAKSLVRAKAGKTTGRGSETGAAGRTAAPDDYEEEPEESWTFVGNDDSNNVHGADLMLQSVILSPDGGKSGKALGSRVLGQVAV

SEQ ID NO: 7970 - protein, 1501 aa, Blastomyces silverae
MPPDDESRTTGASGRSKPHPTSTYRLSSSHIPDRLRMGDDEQEDMTAPPGGTAGRGGRFQYMHQSVFSMIAAASSKKDFHNRFDESSDAEDEDANADADRAFKSRFLSNDGVGGRRRAGSASTSHLPHLVKRDKTTISSTAEERGRSQHRKKLSEHKFLKSLAKLPHRNNKGMEPASEPEPELEEPTVTGEPSSANAVQLVAATEAPVLSRMLDAQSRFGEYEAPPSSTERSRKDHHERKESSPASLLSARLMDIFGFDRPEKVISEYQCWLLQSVLLQGYMYITERHISFYAYLPKKSHTTIKSGYLSKRGRQNPKYNRYYFELKGDVLSYYLDRSNLYFPSGHVDLRYGISANLAEHKGKDKDKDVKDFTITTNTRTYQFRADSAMSAREWVKALQKVIFRSHNEGDSVKISLPIENVIDIEENPVIDFADTFKIRVVESGESYAIDEYFFSFFECGKEAIEVLKKMVSNTPAQQIPQTMLAPDAGYTSRRRRSHSVDEISPPSTHGTTLLSEAVKATLRPHSPLGSRSGSPKQGLDRPRSPFRRFSRSRGHSRESSGAGLEQRRRSGSTNRASVGDNQAETSPGGKLLNSSDSFVQSLEHATDSSAILQSTNGTVESASQILNRSDVFQSPTIHKLRDTLSGAGEAPRRHSEDTARFAPSPADVRIHPPSRTQTTQSLTKPEHQDGGSDSEHDLQHRSVAHSASSPTLQELMKAGSYPLQRAAGLAGYLKSRSKRMSNLLATESMGYFEKVSGMWIGGKRHYGEGETILPDDRMVDPEDEEQGCEHGDRFRAHFALPSSEKLQATYFAYLHRVIPLYGKLYISNRKFCFRSLLPGTRTKMILPLRDIENVEKEKGFRFGYHGLVVIISGHEELFFEFNTADARDDCAVTLHQNLESIRYLVESGLLAQQDREEAEAARAEHQMLQEARLEGMEEEHSSQTLSASAPLSPTSSPILFDDPRVSIVNFKPQEALRITCLTIGSRGDVQPYIALCKGLMAEGHIPKIATHREFEPWIRKHGIDFAPVEGDPAELMRICVENGMFTYSFLKEASSKFRGWIDDLLSSAWASCQNSDILIESPSAMAGIHIAEALGIPYFRAFTMPWTRTRAYPHAFAVPEHKMGGAYNYITYVMFDNVFWKAIAGQVNRWRKRELGLRSTNLDKMQPNKVPFLYNFSPSVVPPPLDFCDWIRVTGYWFLDEGADWQPPAELDNFIKQARADKKKIVYIGFGSIVVSDPAALTKTVVDSVLRADVRCILSKGWSDRLGDPSSAKVEIPLPPEVHQIKSAPHDWLFSHIDAAAHHGGAGTTGASLRAGIPTIIKPFFGDQFFFGSRVEDLGVGICMKRLNVGVFTRALWEATHSERIIVKAKALGEQIRKEDGVGNAIQAIYRDLEYAKTLVRQRSNATSASQAGIVPVATEGSGAGISSETGLDEDGDGEGDADADAAMEDSWTFVGDEAGTELARKTRARERDYDVPVDVVAARVTGSNGSSGSGSHDGRSG

SEQ ID NO: 7971 - protein, 569 aa, Medicago truncatula
MGCNGIEHLCTEVVEDEKGLRKMDDDKLVSVRGEIMSQEDDGSPSSKERGSQSSEVTSLPHRGLEHCITAPIGTERNPLIAEDEIMISRSMTEKRGLRRHDLLLDRLSEDEKQKLIANLVKIQKDGTVQVDIETSASVASELLEFQSFEESVASGNFIISDSNKSVPRLQIVILVVGTRGDVQPFVAIAKRLQEYGHRVRLAAHANFKTFVRSAGVNFYPLGGDPRVLAGYMARNKGLIPSGPTEISIQRKQLKVIIDSLLPACTAPDLETGIPFTAQAIIANPPAYGHVHLAEALGVPIHIFFTMPWTPTYAFPHPLARVSQGAGYWLSYIIVDLLIWWGMRGIINDFRKRTLKLAPIAYFSMYRGSISHLPTAYMWSPHLVPKPSDWGSLVDVVGYCFLRHESNYQPREDFLHWIKKGPPPLYFGFGSMPLEDPKITTDVILKALKETEQRGIIDRGWGNLGNLTEVSDNVFLLEECPHDWLFPQCSAVVHHGGAGTTATGLKSGCPTTIVPFFGDQFFWGDRIHQKELGPAPIPISELNVENLSNAIKFMLQPECISGEISDNGSC

SEQ ID NO: 7972 - protein, 402 aa, Streptomyces longwoodensis
MTVGSRGDVAPFTGVGHGLVRAGHEVTLVTHARFAPLVRGSGVGFHALPVDPRAELESARGRGLHRSGSGAGKLLRAAGLARSLVGRITDDLIAAARTSDLLLLSASVAPLGQAVAAGLRLPSLVLPLQPVTATREFAPPLLGGGSYGALGNRLAGHGLERTVPWVFGPALPALRARLGPAAAFGPTPGRLLHGFSPQVVPRPRDWAPGLDVTGYWWPHDHVTRLPPTVREFLDAGPPPVFVGLGSATVPDPGRLSATVVRALRRAGLRGIVQRGWAGLTADGDDLLTVDEVPHALLFPETAAVVHHCGAGTTAAGIRAGVPAVPVPVQFDEGFWADRLVRLGVAPRALPLRRLTADTLAAALTRATGDPAHRERAARLAARVRAEDGVGRVVAAVERLGRA

SEQ ID NO: 7973 - protein, 847 aa, Rhizoctonia solani
MYPNQRDSAFSNGRSQRYHSYQELPVPASSAPSSAYNSPNSAARSFESLAQATIQPPPPPLYTRHDHGSQAGPSEPRHSYSSSTSQITLPEKDLPGLPGYTQLDAKTAVSEDGRLTISFGHRMSKTFPDSYGAPVHEIGIDETGFRSAPRMNINIMIVGSRGDVQPYLALGKQLQQYGHDVRLSTHETFRKMVKDAGLRFYNIGGDPHELMSYMVRNPGLIPGIKSLRNGDIGKKQKMVGEILEGCFASCFAPDLGSGEETGFAADAIISNPPTFAHIHCAEALGIPLLLSFTMPWCPTASFPHPLVNIKQSENTEPNMANYYSYGLVDMMTWQGLGRTINKFRMKRLGLDYLTTASAVGMIERCAVPWTYCLSPALVSKPADWMSHIDVVGFYFLDLASDYSPPENLVEFLKSGEPPVYIGFGSIVLQNPQEMTRAILSGIAQAGVRAIVSPGWGGLDEDLIRSAGPHIFALGNVPHDWLFQHVSAVCHHGGAGTTAIGLKCGKPTIIVPFFGDQPWWATQITRRGAGPPPLDPKTLTAEAFAVALRIALSSTTMRAAEMVGEMIRRESGTQNGVDSFHRHMPLLNMRCDLDPTRVAVWYSPMHEMRLSAFAAQVLSEGGYIDINKLELHRSREYASHADVWDPVSGALSPAMKIFSDFGRGVSKLPTRPDKGMGQIVAAGTFGAQSTLQGFSSGMANLPRLYGGQMRERKKVNGVGSGMVEGTKSLLFGAYDGINDLFMEPVRGYKEKGILGAAAGMGKGTLSATTKPLAGVLQFISQPLEGTAKDVRSLFRKQVGKERIAARYAEGVLAVRKASQKETETLVQTFIEMRGRAGMGGKGKSKAVW

SEQ ID NO: 7974 - protein, 1203 aa, Saccharomyces arboricola
MPITQIISASDNETGSKPSTPLVPDMLSRISRRHHRLSKSLSKLKHLRSRSESSSSIDSAEQQDMKTGLNEVYSDNADDYDDDGLSNDNADDLAKSKYMMKSIAGLLTTASVYAGMNNAQEMNTLTRIDSEESDSNESGQANLGENEVRSKKENLQKPSPDALRSDKRSLTLFDFSVTKEKLSKENVTKLRERFCLEEQESFLYDFPAWLLKDVLVQGHIFITMKHFLFFAYLPRNPRSVKMSGNLNIRTKLLRSTRYWCVLKNHLFSMYASSTELYFPVLTIDLRDVQKIEPQKSSLNRNTMKAFKLYTSESTFKFNADSEFSAKSWINALKKEQFAAQNSENNSISLKIPLPNVIEIDDQPIVDKALTLRLRALESSQTYAIDDFMFVFMDGSGSQVKDSLCQQLAALQQSGVSTLYNDISAKNAISSDEKGLSATAELRKVEKDDSKDSKYSTVQNPAVPSSENGKKGKFELRERRNSWFRRAKCLEDSQIEDVEEIYKDATDEIDSYTNSAIQAQEGEDNQEQGVDWKQSHLKNFAEMWAAKPIHYRNKHIEFEKDDPYLTKETEDISANERFRFHFKFNKDMSLISTYYTYLNRNVPVYGKIYVSNDVLCFRSLLPGSSTHMVLPLVDVETCYKEKGFRFGYFVLVVVIHGHEELFFEFSTEVARDDIECILLKLLDSIYTSSREGSNVSTTSVGDVQHNPDSAKLKLFEDKINAEGFEVPLMIDENPHYKTSITPNKSYKFGLLTIGSRGDVQPYIALAKGLLKEGHQVVIITHSEFRDFVENHGIQFEEIAGNPVELMSLMVENESMNVKMLREASSKFRGWIDALLQTSWEVCNRRKLDILIESPSAMVGIHITEALQIPYFRAFTMPWTRTRAYPHAFIVPDQKRGGNYNYLTHVLFENVFWKGISGQINKWRVETLGLAKTNLFLLQQNNVPFLYNVSPTIFPPSIDFSEWVRVTGYWFLDDKSTFKPPSELEKFISEARSKGKKLVYIGFGSIVVSNAKEMTEALVEAVVEADVYCILNKGWSERLDDKGAKKVEVNLPKNILNIENIPHDWLFPQVDAAVHHGGSGTTGASLRAGLPTIIKPFFGDQFFYAGRVEDIGVGIALKKLNSQTLAQALKVATTNKVMKDRAELIKKKISKEDGVKTAISAIYNELEYARSVTLSKVKGPRKNDDNVDKTKLPSGETTDEAWTMI

SEQ ID NO: 7975 - protein, 416 aa, Calothrix sp.
MKIVIITVGTRGDVQPFVALGVALKQAGHTVTICTSSRFQLFISEYGLNYAYMNDQLLKLIDTDAGRAAIESKGNAFFLWQQTMPIIRQTLDEAWIAAQEAEILIYHPKALGGYHIAEKLNIPGFMSLLLPLYTPTTAFPSPIFPNLKGGWYNQLTYQLLPLLTAPYLNVINQWRQERLGLRPRSWNEKEILGSYGDSSPVLYAYSSHLIPRPSDWDSSTIVTGYWFLDAPADFVPPPQLLDFLANGKPPLCIGFGSMTGQNPTALREIVLTALKNTGQRGILLTGWGDIGNADLPNDVFKLEAIPHDWLFPQVAAVMHHGGAGTTAAALRAGIPNIIIPFFGDQPFWGQRVEALGVGPKPIPKKHLTAEKLAAAINVAVNDEEVRRRALSLGAKIRAEDGVAQAVKVINRFSSLS

SEQ ID NO: 7976 - protein, 622 aa, Triticum aestivum
MGCNSEAVAGEGSGSGDLRRRRGGRDGAGASSSSSFAEGTREFVLSSMDERFSGSVDADGFPSSRREGFGHSKSTTATSSRFRGQDHAFVRSYSDRLLKCDLTLDMLSENEKMKIIEKLVKIQKDGTLEVDVTRSALVASELSEIDAFGSVPRDVEEVKSGFSKSVPKLKIAILVVGTRGDVQPFIALAKRLQEFGHHVRLASHVNFRTFVKSAGIDFYPLGGDPRIMAQYMTKNKGFLMAAPTEISVQRKQVKEIIFSLLPACTEPDLDTGIPFRAQAIIANPPALGHLHIAEALGVPLHIFFTFPWTPTNEFPHPLARTPQSATYRLSYLIVDLIIWWGTRGFINDFRKKLNLAPIAYFSTYHGSISHLPTGYMWSPHLMPKPNDWGSLVDVVGYCFLNLGTKYQPPPELSQWLQQGSKPIYIGFGSMPLDDEKKVTAIILDALREMGQRGIISRGWGDLGSFSEVPADVFILEDCPHDWLFPRCTAVVHHGGAGTTAAGLIAGCPTTVVPFFGDQFFWGEIVHARGVGPAPIRVTELTTEALSNAIRFMLDPEVKSRSLELAIAIGNEDGVAAAVDSFHRHLPSELPLTPPPAPAEEERLDLLQLLSRYLEKCCLPFNS

SEQ ID NO: 7977 - protein, 410 aa, Streptomyces glaucescens
MTAGSRGDVAPFTGLGQALVRAGHEVTLVTHGRFAPLVTGSGVGFHALAVDPRAELLQTPRGQGMSRSTSAVGKMVRLAEMARAAAARMTDGLLAAAEDREVLLLSGSLVPLGHGIAEGLRLPSIGLHLQPLDPTREFAPSVLGARSWGAVGNRLAGHGMGLAMEQVLSTAVLEVRDRLGLPRQRPWAAWRARERADWPVLHGFSPLVVPRPRDWRPGLEVTGYWWPYDRDPGLPPELRDFLDTGPAPVFVGLGSATVPHPERLSAELVRALRRAGLRGVFQRGWGGLAADGDDMLTVGEVPHSVLFPRMAAVVHHAGAGTTAAGVRAGVPAVPVPVQFDAGFWAARLVALGVAPGVVPLRRLTAGTLAPALVRATRDPAFRERARTLAARVRAEDGTAAVVERVNALRG

SEQ ID NO: 7978 - protein, 885 aa, Aspergillus calidoustus
MASNRNAEVFELPGDSVMTTTMASNNHPEVFELPGDPVTIPPTPIAGDSKSGISITSDGRVDIDYNTTLIRRFSKLYTSHYSPRPTTPPPEYSEIAPQAADDNNIRFGSPPAYPESSWKIKLNILIQVVGSRGDVQPFVALGNELQRYGHRVRLATHDVFEDFVRGSGLEFYPIGGDPEELMAYMVKNPGLIPSMRSLQAGEIGRKRAMIREMLDGCWRSCVEPDTATQLPFVADAIIANPPSFAHIHCAQALSIPVHLMFTMPWTSTKAFPHPLANLTGGGDEDQGFRNFVSYGVVNWLTWQGVGDVINQWRKELGLDEVAMFEGPRLAEILKIPFTYCWSPSLVPRPSDWPSYVDVCGFFFRESPKYDPSADLLSFLAAGPPPIYVGFGSIVLEDPERATAIILNAVRAAGVRAIVSKGWSNLGGMRDDNIYYIGDCPHEWLFDRVAAVVHHGGAGTTACGLRKSKPTIVVPFFGDQPFWGDMVAAAGAGPTPIPHRELTVDRLAEGIRYCLGEQARLAASSIAAKMQSEVGVKAAVASFHRNLPLERLQCDLDSGLAAVWSFSKSRRKFKLSKIAAQALIADGSIDAKSLTIHAIRPIFIENRRWDPVTGGASAVVGTATDVADSVLGAFYKPVLEYRNYREEREDPLSSRRSNRSVDNISKELSVDRVSTDHEKEPKGLEVASSNASTLSADSHSQKRTNTGKGKLLGRMAGASAKSLGSVGPTMIKGATVGFPLAITEGLRNVPRLYGEVPRDHGPVTDIKSGFAVAGKGFAWGMAEAVSDIVVKPYQGLQEEGAKGAIKGVGKGVTNMAAKAGSAMFGLMAYPTAGIAQSLRSSGQSQTRKLIAKQRHSEGIWLLESGQCPATDDIVATFRQKLKSKKA

SEQ ID NO: 7979 - protein, 1525 aa, Rhizoctonia solani
MESSTSPPNSIQNPIRGTTINTSAGQLGLSNSQAHPQAHPQSTMSESHDSSDESDGGKGILKRTVEKIGRNTSLTRSKRHPDTDSRAHRRLFSLSRHKGKDRAADEFAGMLGGHAAGGGSSDADVSIQKSRTPTNKSPKSSPRVPRMAATTSDLRRNKNQASDSRPSLSIMGLGKQDEFGIGSMRMGTQALIQALQAMPWDDDRDEDGPESAAKRDRGKARREPVSPDSSDEEGQAKADFVLASSIHTIHRPVAHSRLATPSFNQSIHYGINPPLEVAEDYFSNPLSADEDDALRDFDDATAPEGLPNPFKDPSQMRLQLPADKLPKTEGKRRMPPTVRTASMATVRMKRRTKLAEKLKEVFGIPEIKEVVAGRLDALVKIGCSCLFIRKHARWLTYLGAVLQGYMYLTNTHLCFFAHMPTREDQVLKSGTMSKKAQRTKRWNKHWFVLKNDVLSWYQSSSVRFRYDPYFPHGNIDLRYAISCDAHREKGIRLRTNQKTITLQADSVPSRDEWVKTIRKVIFKAQNMGESVKIAIPYSVIDGVERSSAMDFSETIEVKVIDKEENYALDSYFFAYFRDLPAALAQIQQVLSDYQDTTPAVEVHLTDTTQINRSPQQLHLDRTTSAPASSHQNDSTSGFRISSLLSLRPFSTTSGNEEIHKGSSLVESQGGESVPIQRDTINSESAAPGTSSVLSEVSVHTYPPSPSNQAPPSTHSNRTSISSNWSVPGYNWLRGKRIFSTPSSNEWGSRSTEGNVSEIISSPRLDQSELSVSSDGHNLGFSILEAAEDGKLADAGLEEKFRSTFALDDKEALLGCIPGSLFRVLPVYGRLYVSTNYFCFRSSQPLTRTRMMIPIRDILSTEKQKPFRFGQHGLVVVIKGHEELFFEFGSSERRDTCRSLLEMQKETLEKQALSPISPTPTQGKRDALILEELEPSMLISDDDPRPAPEVLASDAPVMFASTSSTLLTFKPEKPMHFTCLTIGSRGDVQPYIALCKGLQADGHKVRIATHKEFQSWIEGVCSLHTMVEMTTLIQRSLFQFRGWIDDLLETSWLACQGTDVLIESPSAMAGIHIAEALKIPYFRAFTMPWTRTRAYPHAFAVPERKMGGSYNYMTYVMFDQVFWRGISGQVNRWRRHTLRLPSTNLDKLEQHKVPFLYNFSPTVVPPPLDWYEWIRVTGYWFLDDPEDSSAKKWTPPPDLVKFMDNARRGGKKIVYIGFGSIVVSDPDAMTQCVVEAIKLSGVHAILSKGWSDRLSTKKSNTETPPTYPPQIYPISSVPHDWLFERIDAACHHGGAGTTGASLRAGIPTIIKPFFGDQFFWSDRVEALGIGSSVRKLTVENLTAALRAATTDVKQIERAKLVGQSIRENGVRTAIEAIYRDLGYATELFRKDTQVDLDADGSEDETIQESKTPAARRSSLDPVMIGSDSSCGSGRGNGEDSSWSVISDHPPPERVRVESIGSEKRPSGESGDDSISEAGTPNADQTQQTQASGSRGLSGLPAIGLALLQETLTAYSPSARGEPNGKQ

SEQ ID NO: 7980 - protein, 1188 aa, Antrodiella citrinella
MHDDDPTGHPITQVPEGPPKYPQNVDSDKGADFATSPDARASRVKRAMEKTADKLGRSKSAGNKSPAMTQSQPSLPASGHRRIFSLNRSKGKERASADGRRFIILSNGSQEISSGERLDEMATAQSQYITTPTSPSPAGRYTGRSAATAADDDSPFITPRSPPFGPTRSVFNIFRGDGSLRAGTQTLIQALQAIPWATDDQDNDDDAAHQESTDSESDEEDKPASWLASSIHTIYRPVARSRRKDRASRSRPEPHKHGLSDIEDEPAPEEPILSDEDIEEDFEPTAHVSHKSFRERLSITLPPLPELEPSALTGVTKPVPVRSGSMATVKVQRRARLAEKLRDIFELQGISEVIAVGEKDIRLRTNQKTIRLAADSIPSRDEWVKAIRRVMFKAQNMGDSVKIAIPYSAIVDIERSTAMDFSETIEVKVIDKGDTYSVDSYFFAYFHDLPGALEQIRDAVRSSRGIPEDTTPPAVIDTTISRSPPPTPVPTDRLSWLPILEAPGLPLDLDVVEKFRTAFAFDEKESLLGYFSGYIFRLLPVYGRLYISSNFFAFKSSGPLTSRTRMILPLRDILSTESSKAFRFGHYGLVVIVRGHEELFFEFADEERRSAFNSLLQRQMEDVRRRAAAGEEHPRTEGQRDALILEEFGPRAQTTGSEILPEPESMSGSLPAVMFTSTSSTFLTFKPKESLHFTFLTIGSRGDVQPYISLAKGLIADGHKCRIATHGEFKEWIEAHGIEFGYVGGDPAELMRICVENGMFTVSFLKESMAKFRGWIDDLLKTSWEACQGTDVLIESPSAMGGYHIAEALGIPYFRAFTMTWSRTRAYPHAFAVPEHKMGGNYNYMSYVLFDQVFWRGTAGQINRWRKNTLGLPSTNLDKMEPHKIPFLYNFSPVVVPPPLDWPEWIRVTGYWFLDDANVGAAKWQPPPDLLEFIDTAHKAKKKVVYIGFGSIVVSDPKAMTRTVVEAIVQSDVYAIMSKGWSDRLVKTSTTDGPDTAEPLPKQIYQISSIPHDWLFKRIDAACHHGGAGTTGASLRAGIPTIIKPFFGDQYFWADRVEALGIGSAVRKLTVPHLTEALLAATTDQKQIDRAKMIGENIRAENGVATAVEAIYRDLEYARSLIKGRVHAMEHRDAFDASDHEHATIRESKGHSPHPRTGTHSGHSSIDSSRRGAVSDWSVISDQEDAQS

SEQ ID NO: 7981 - protein, 1465 aa, Suillus luteus
MSKLSPWKPHARNTAAPSPQENENLSQDPRLLDHVEQDEDSSSSPQSRAKRLALRTKDFSKSIGGRAQSPSSPKSSGEHRRMFSLSRKGKAKEPSDQSEVAVAPSTSLIPKQVPSNGNIDTEALLSDAVQDDSPFIRPPSPSPLCNRPTLQAFRGTGSMRAGTQTLIQALQAIPWADVSDHDEDLTNVITPHGDDDSDEDSGAVPMASSIHAIYRPVARSRRTEASLSSRTVLPSPEEGHESSDGDLDGICLSEEDADAEDFEAATPRPEHVPKPEHATSELPMAFRPGVHMRRRASSHAGSITTVKVDRRARLAEKLKEIFELNAIDEVLAEMPCWLLRSVLLQGYMYLTNSHLCFFAHMPSREDQILKSGTLSKKANRTKRWTKHWFVLKNDALSWYQSSSDPYFINGIVDLRYAISCDPSGEKEIRLRTNQKNVLMSADSVPSREEWVKAIRKVIFKAQNMGDTVKIAIPYSSVIDVEKSSAIDFSETIEVKVFDKDQEHYTVESYFFAYFQDLPVALEHIRDAVRSHRSLVTRSPLALLDTTATRHPQPSATQGMDRAKSLPTPDTRFGSSFRLSSLLRPFQDSLPASLGRMNNVPGAPEPTEVPDDYTHIIKRSGSSLVPITTSPDPISSPESSKALHALSRASTIATPTDHTYPPSTSVSDLASSPSAKSFPSSAPWNVGVPSWLKVPRSRLSTSTSNASSLHASPIGDGIHEVYSVPESTTRQSSGITQGDLGYSVLETPEAAVDPEATEKFRSAFAFDEKEILLGYFTGYLFRLLPLPGRLYVSTNYFCFKSTGPLSSKTRMILPIRDILSVEKTKGTRFGHYGLTVVIKGHEELFFEFGFDDRRKAFVGILDRQMEEVRKRTSAGDVSVLSQGKKDALILEEFEPGNSSDSDPTPPPESMSESLPAVMFTSASSTFLTFKPKESLHFTFLTIGSRGDVQPYIALAKGLMEDGHRVKIATHGEFREWIEAYGIEFGYVGGDPAELMRICVENGTFTVAFLKEGLSKFRGWIDDLLKTAWEACQGTDILIESPSAMAGIHIAEALKIPYFRAFTMTWTRTRAYPHAFAVPEHKMGGGYNYMTYVMFDQVFWRAISGQVNRWRRNTLHIGNTSLDRMQIHKIPFLYNFSPTLVPPPLDWPEWIRITGYWFLDDAEVGAKKWTPPPDLLPFIDSAHEAGKKVVYIGFGSIVVSDPVAMTQCVVGAVLRSGVYAILSKGWSDRLQTKSSDASEPEEPLPKQIYSINSIPHDWLFQRIDAACHHGGAGTTGASLRAGIPTIIKPFFGDQFFSADRVEALGIGTGVRKLTVESLTEALVSATTDIKQIERARLVGEQIRIENGVATAIEAIYRDLDYARSLIKRTPHESEAVHDVEGAARDEQNAQSTLERSGSGSRASVDSRRVSEDWSVISDGDDRRPSGSGRVSDGKLDRSSTFKRSSLAAAVMSVLPDALTPHRQSTAL

SEQ ID NO: 7982 - protein, 1670 aa, Wallemia hederae
MKTSLRNLEKASQKLFRDAIKEESTQSTQSTQSHNKPLRLSKLATDAASKDAWDGDEHPHDTSLRMLLDARKPLRGGDKNPYREGRLKTVQQPAQPSQPSHLENLIPSDPNYMPWHAEYVYPSHASGSSAAPSIYRARKLESQALEKVQHMEVDSKTKAMIRDTKRSKTKVRRLVNAREGALDYSLAGSLDEIENTNETKERHRVQSQTRPRPQSLKAWNSLVEEQIEDAHRKGQFKNLNGRGKPLASVSQGNAFISREEFLMNRLINQQGAVPPFVELQMTMQSEVMSFCNYLREEYVKRGARYLDRNATEDSVRRWRDVDWENRQKSYHTILIDRVNSAIKSYNAIAPPFSRRGLLLLDREVENARLSAVPLIVASLAGDGKSVETAPGSAAPAKSDTWLGRIRGNSGDTRDTQAVQMSQSTPDASHASPPPPISSTGINEGYFQSIPPNELTQQGTSSAFLTPHSSWRGDVNMRMGTQSLIQVIQAFARHADDNSNDDEEDTHEEQPQEQNVMDMYSSLNTVHTEHDDNNDAHNLPESSASTPQTNTPHESDNDSDDGMASDDSAIKRSRSQSLKKKSAQRRRTLSTKLAEIFNLQDEEEIHAEYRCSLLGSSYRPMLEGFLYSTDSFLCFFAHVPIPARDIVVKTGAIGKRTLRTRRIIRYWLALKDDVLSWYGSATDPYFPVGNIALRYAIRCVTVKNSDREFSIVTSERKFTFVADSPVGRNEWVKVIRKGMFRSQNESGSFKLVVPYDHIIDIERSSNLEFADSVAVSFVNNEDGSDCYYFDHFKDSQLASDVLRQILDSHRQNVHRILSNENLTSSPTRLKEEFLDGSEVTARPTSRGQGGDHTYPPHNTTQNRSRSASLTAEIPSWIKSGSLKLGKAVYSAPRMIPHPHLSTILPRLPSIPFLNNNNNSNNSATQQRQTLPNLTPATHTLMRTDSRVCETYEEPAHKETSRSRSNTASSSEFEEVGSDFSVLEHSAGLEDVLKVEEEVQNKFNDYFALSGESILGHFNCALFRVYPVPGKVYITNNYLCFRSFQILGRTKMILPLSDLQAVQPHKPLRFSFHGLIMIIHRHEELFLEFTTVNRRDACEKLLSTQLDRLFRRSALQHTESSKGLQEAQIIEDLSLSYRHPSLTAPVMHDDSLSSSTSVVSFKPTKSLRITCLTIGSRGDVQPYIALCKGLIKEGHQCRIATHGEYKNWIEENGIEHREVGGDPAELMQICVEHGTFTLSFLREGLFKFRSWLDELLKRSWEACQETDLLIESPSAMAGIHIAEALKIPYFRAFTMTWTRTRAYPHAFAVPEHRMGGSYNWMTYTLFDQVFWRAISGQVNRWRRSTLHLKGTNLQRMAQNKVPFLYCISPTLVPKPLDWNEWIHVTGYWFTDSINTDNDENKKELEWEAPEGLLEFIGEGRSLNKKVVYIGFGSIVVNDPDAMTRTVVEAIERADVYAILSKGWSDRMHTDKKKEELHLPKCIFSIDTIDHAKLFPLIDAAVHHGGSGTTGASLRAGLPTVIKPFFGDQFFNADRVEAANLGASVRKLTVDSLSKALKDATTDEKQIANAKKVGERIRSEDGVGTAIKCLYRYMEYAQNVVTTRANDHDKMVDTNDDTNDNETDNENLDDDWALPSENMTDDEMHESFGVLSLASNLGKKSLGVGKDLLLKKT

SEQ ID NO: 7983 - protein, 1366 aa, Aspergillus ruber
MALRDDTKGRLEQRLSPGKKSKSTTRLYSHPLPERLKHDGDDAQVDFTAPPGVSGSKDGHMHYMQQSIFSMIAAVGSRSDFHTRFDESSESEGEIEERQQKDGSSDRQRKAGIPEKELQSTLEERGRSHRRTTSEKKLLSPLERLNLKHGGGNMSASQTVGSPPRRPRSATPRAAPVLSRMVEAKSRLEKTPSTERLQPEPKDNTQNDTEQQSASLLSTRLMEMFGFQKPEKVVVEYACALLQSMLLQGYMYVTEGHICFYAYLPKKSTVAIKSGYLYKSGRKSPKYTRYWFSLKGDVLSYYADPSNLYFPSGHVDLRYGISASLSEKDKGKETRDFQVTTDQRAYYFRADSSANAKEWVKALQKVIFRTHNDGDSVKVSFPIENVIDIEESPMAEFAETLKIRVLDSGDTYAIDEYFFTFFEFGQEAFEFLKGLASEASSNRASQLPSPQRDHAQKRLSVASGTGLPDNDQTGRRRRSVSGSHFSSVGQGILDKSPPVKQQDSSGLFGSSIDQESESPFWHSNTVESASQILNRSDVFQAPTIHSLGRQPSDAEGVTGRRYSDDTARFTSPHASHSFSPRKDDYEAQDSGLDHTAQDPTKVQSSTASLNELVKVGVYPLQRAAGLAGYLRTRSKAMSNLLATESMGYLEKVSGMWVGGGRHYGEREGIISEDQAVDPEDKEDGCKYGDRFRAHFALPPSEKLQATYYAYLHRVLPLYGKIYISQKKLCFRSLIPGTRTKMILPLRDVENVEKEKGFRFGYQGLVVIIRGHEELFFEFNTSDSRDDCAVTLHQHLEAAKFLMESGILAEQEQDGSEAAQAEHLMLQEARLGGADELESRGSLNGSSELNPIFDDPRASIINFKPTESLRITCLTIGSRGDVQPYIALCKGFIAEGHRPKIATHAEFEPWVRKHGIDFAPVDGDPAELMRICVENGMFTYSFLKEASSKFRGWIDDLLSSAWASCQDSDLLIESPSAMAGIHIAEALQIPYFRAFTMPWSRTRAYPHAFAVPENKLGGAYNYITYVMFDTVFWKAIAGQVNRWRNNELGLKATTLDRMQPNKVPFLYNYSPSVVVPPLDYPDWIRITGYWFLSEGSDWTPPAELTEFIQRARADGKKIVYIGFGSIVVSDPQALTRTVIESVQKADVRCILSKGWSDRLGDPGSVKVEVPLPTEIFQIQAAPHDWLFSQIDAAAHHGGAGTTGASLRAGVPTIIKPFFGDQFFFGTRVEDLGVGICMKKLNVSVFSRALWEATHSERMIVKARDLGAQIRSEDGVGTAIQAIYRDLEYAKTLARQRSIASSTPFSPKPSPKNADEPEASDDLDDIEEWTFVGDDTDIDISKRMRDRAISDIDMLPGRLHENIGVGES

SEQ ID NO: 7984 - protein, 201 aa, Unknown
  Description of Unknown: Oryza sativa Japonica Group sequence
VPSMGFLRNPKAFLMVLKAVIEKTDYRFILFSSGYQPLDSAIQYFAPSVAESSEYQASALHCDSNLLFNGRLFCFSGSIPYSWLFPKCAVAIHHAGSGSTAAALFAGIPQISCPFLLDQFYWAERLHWLGVAPEPLGRQHLIPDTDNASSINSAADMLIGAIKSALSPEIKAQATRIANKLSSEDGIGEALRILKESFAPN

SEQ ID NO: 7985 - protein, 1083 aa, Laccaria bicolor
MSVLARLFSLSSKHKSKHSDTFSLDRGSSIDSSHIDEDATDSPRCPSISQLYNEANAFEKVLQCSGCVKPLTSRTRTSNSGFESLVRHDLNQSELAMANHDAKVAATASSWVTADLDSKDSVQYDAEDEYRISSDSSSDADIALPTIHRVPNHDNEELAKLKPEEIVRILIQEFGELAGPDEEELLLLETDGCLFSEISVVGVIHLTTHRLTFHASLLATRPDLSPSRQVLKAGPATFHRKGWRVKRRLWVELTHDMICSYASSKEEDKTRPLCTTLLSFFHEVLPIDPKHPRFIRFVIKDAAHSANDYVELDTEESAHDWRREINGALSLQRHRRMELYSPTADSEAGVRLSCPLDRIIDFQTHCNADFLHLVSFRVQLTPADCKEDVCEGMSESPVIQVGPVQHIPIWDQLQDRIDIAKRRVQNEPPNPQSVFFVDFGPFRFLQRDNVPSKDEGYITHREKAIRAALGFAAESELWFARARVYRTVTSVGYFAISRRHIGFWSKNLTQRNITYSIPVTLIRYAEPFHLNWVLVDGLTVGVEGQAEMRFVFRSAAIRDAALEHIKQSISSCQSGTVVASPISSRPGSPETQEASVKPTHHMRRRHAKSPERSATGIFAPLSRSLSAAVTAAADLPLNFQRRIPKVVNLPREILIARASLHFVCLTIGSRGDVQPYIALGLGLRKEGHRVTIVTHEEYRDWILGFGLGHRTAGGDPGALMKLSVENKMFSPEFFRLSLNNFRPWLDQLLVDSWKACSDADVLLESPSAMAGVHIAEALAIPYFRTFTMPWTKTSEFPHAFLSPPVESPTFNSASNVMWAATSSQINKWRRHTLRIGHTDMGHLAQSKITFIYNFSQVVVPKPLDWPDTTIISGYWFLDNPDLDWEPPTELIDWMEESRREGKPIVYIGFGSITVPHPNRVTSHIVKAVLQSGVRAVISKGWSTRMKSEDKGPEIEIPRECFLLDKVPHDWLFPRIDAAVHHGGAGTTGASLRAGIPTLIKPWFGDQFFWASRVQRLGAGLRVSLRVSDLSDALVKATTNQLMKDKAASVGRRIREEDGVHTAIFTIYTYLHRASQDRAMLDKH

SEQ ID NO: 7986 - protein, 403 aa, Streptomyces acidiscabies
MTAGSRGDVAPFTGVGHALANAGHEVTLVTHARFEPLVAGSGVAFHALPVDPRAELESARGRSLHRSGSGLGKLARVVGLARSLVGEMAYDVVAAARKSDALLLSASLSPLGHVVAEALDLPALDLPLQPITATREFAPPMLGAGSYGSLLNLLAGHVVDRSVDHVFAPALPSVRAELGVPRPPRRVRRPRRPMLHGFSPSVVPRPTDWRPGLEVTGYWWPYDTTTQLPPHLRNFLNAGPPPVFIGLGSATVPDPAALSTQIVHALRMAGLRGVIQRGWADLAAEGDDILTIEDVPHALLFPRMAAVVHHCGAGTTAAGIRAGVPSVPVPIQFDEGFWARRLVTLGVAPEAIPLRRLTTERLAEALRRATGEAEFGERARELGERVRGEDGVSRVVEAVGALG

SEQ ID NO: 7987 - protein, 1399 aa, Trichoderma reesei
MATTPTPRYISPDGHEDADAVTATATAPLSPPPNDDRTPTVELPEPLQGSDDETSENVGPANPGHMAVNLNQSIFGLIAAAGSRVDFNTRFDDGSSDEDEGSSLKPLRSRHRDLSQTAILGSLPAKDKRLGKKQPSGHRMLKSFASLPKRTSRSGKGSSRLWEPTQEVDEHSETSESPSPKISLQQPEDDLRIAPVMSRMLEAKAEMASRSSFDTERDSSEDNEHSDGEHVTELAKKLMEIFKFDEPERVIEEYPCWLLQSVLLQGFLYITSKHICFYAHLPKKTHTVTKSGFLLKSGKRNPKYNRYWFRLKGDVLSYYQDPTNLYFPHGHIDLSFGISASVTDEDKEGVHFDVVTSHRTYKFKAESAPSAKEWVKSLQRVIFRSHNDGDSVKISLPIDNILDVEDTQMMEFSDTCKIRVIDSDETFAIDEYFFSFFNSGKEAISVIKVLVENASAEGPTAGKVIAAQKEESSNQSSPHISGTAFRNLTRVDSALTTKPLGTARGDGSPAWADSTSPSADEAGVLSLRSSRGRSSSDNKTSDHAEERRESRLLESSESNLYSSIEEPSFASLTQSAFEDPSASQILRGSDVFQSPTMRHSQTSSHDYGEFKGKDAASGQGPHSSAAASQNDASSYSGFVEPPRTSTPTLQSITKIGAYPLQRAGAIAEYLNKTGKRMSTLFATESMGYVEKVSGMWKGERKHYDEPAGLRPDQDELEENDDGQIQTSNERFRAHFALPDTERLQATYFGYIMRVLPLYGKIYLSGRYFCFRSLLPGTRTKLILPLKDIENAHKEKGFRFGYSGLVVVIRGHEELFFEFRTAEVRDDCAVTLLQGLETTRHLLESGILEQHYRDDARAAIAERDALSIARGEALVDGKHDLSQSTALSHVPDMTPGDDMEASVVQFKAPHPMRITCLTIGSRGDVQPYIALCKGLLAEGHKPRIATHAEFQGWIESHGIEFACVEGDPGELMRLCIENGTFTLSFLREANATFRGWLDDLLDSAYKACEGSELLIESPSAMAGIHIAEKLGIPYFRAFTMPWTRTRAYPHAFVTPENKMGGAYNYMTYVMFDNIFWKATAHQVNRWRNKTLGLPNTSLEKMQPNKVPFLYNFSPSVVAPPLDFSDWVRVTGYWFLDEGSDYEPPQELRDFIKKARDDGKKIVYVGFGSIIVNDPVKMTQEVIDAILKADVRCILSKGWSDRITGRDEPVRPAAAAAVEEPVMPPEIHVIKSAPHDWLFRQIDAAAHHGGSGTTGASLRAGIPTIIRPFFGDQFFFASRVEDLGVGVWVKKWGTKSFGRALWEVTRNERMIVKARLLGEQIRKESGVETAIQSIYRDMEYAKSLIKHTDGHLEAEEDEDTEESWTFVRGDEPDPDVITTKLSEGLDGVALGNNNSKASVKA

SEQ ID NO: 7988 - protein, 421 aa, Gloeothece verrucosa
MLITMLTAGTRGDVQPYIALGVALQAAGHYTVRIAASLSFENLVTEYGLDFYPLPGDLSQIALDSRVRKAMQADNPLKIIMSFNRLKSLVFDLQKDFYRACQGSDAIIYHPGAAIGYFIAAAFNIPSILASPFPMTPTGDYPALIFYNFPRGGKSLNRLTHHIFEQIMWGMSRSHIKAFWQQEFGMAPPHFANPFKKQQTLQHPTIVSCSNYIFPKPQDWPEQVHNTGYWFLDKADHWQPPRELQDFLQNGPAPVYVGFGSLGDPTQSEQTTQLVIDALSRSRQRGILATGWNGMTRLASIPENVFMLDSVPHAWLFPQMSAVVHHGGAGTTAAALRAGVPSVVIPHANDQFAWGSRVYSLGVGAVPIPRKKLTAEKLSTAITSVLRAEVREAAKALGEKILFEHGASRAAKIIIHCLQQW

SEQ ID NO: 7989 - protein, 432 aa, Leptolyngbya sp.
MKVLIVTLGSRGDVQPYVALGQGLKTAGHEVTVCTSMLFQSFITEQGLHYGHMNNQLMQLMDSDAGRDAMENTNNLWGTIRTNIKLFSQVKSMYRQTLQDIWQTTQSVAPDLLILASKAAFMAEAIADKQKIPLVIALPFPQFVPTAQSPAMGFPDWPLGRWYNRLTYWIVHTAIGLYGGIPNEFRRQVLQLPPKPKGMDLLHRADGSPIPVLHGYSQHVVPRPTDWPEAAYVNGYWFLEQHDSWQPPDDLKAFLEAGAPPIYIGFGSISGSQPQRLAKVVLEALQTTHQRGILATGWGGLQTGDLPKTVFQLEQAPHDWLFPKVSAVIHHGGAGTTAAGLRAGRPTLICPFFGDQPFWGKQIYTLGVGPKPIPQKQLTISKLAEAMHELVSNQTLRHNAETLGEKIRAEEGVGNAITLLETLFSSQPLGRY

SEQ ID NO: 7990 - protein, 1449 aa, Gymnopus luxurians
MSDEPASRPTSPAPARNVRNALDKLSKSPKRMLSLTRKGKLRDTTTTTTITMSNDDSPFISPPSPPLSPSAAWPGDASMRVGTQTLIQALQALPWASDQDHDDDIAIHDPSALTEEPEGVSSDDESSPPHLASSIHTIYRPVARSRRMSITTGSRSRLPIPESSDETAQSEEDSEPEAEDFEDTTPKPPEAAEPSHLQLRSVSYMSQRQLSSSKLPERVAMTRSGSMATVKQERRTKLAEKLREIFELEDIEEVHAELPCWLLRSVLLQGYMYLTNTFLCFFAHMPSREDQVLKSGSLSKKAQRTKRWIKHWFVLKNDALSWYQSSSDPYFPHGIVDLRYAISCESTGDRGFRVRTNQKTVILSADSVPSREEWVKAIRKVIFKAQNTGDSVKIAIPYSAILDVEKSSAMDFSETIEVKVYDKEARDHFSIDSFFFAYFRDLPAALDQIRDAVRSRRTEGETTHHVLDTTTTRTLPFPVPEKPSSNIPSGSTSLFKIPSFIRPFSEPRIHTSLSTSSEQPHEEFTHITKRAHSSSFVPVTSTPSPRKSPDVKGVTEETGDSNLTPTASTIVIDSSHTYPPSTLGSPVSPLHPGSVRSSLGTNSMILSPTTSSSSGSWTAAVPSWLRVPTRRGLFSGGGVTSSDVLSVIPPGGKVKELYTSPTSTSHPASSWSSSSKFASAGAGAGAGDLTYSILETPNLPVDDEIATKFRNYFAYDEREILLGHFPGYIFRLLPVYGRLYISLNHFCFKSSGPLTSRTRMALPIRDILSVEKSKATRFGHHGLIVIVKGHEELFFEFGAEDKRDAFVLLIERQIEDVRRRLAEGDSLAAGGGETGMSQGQKDALILEELDVHHSPTHHVGPTHGHGHSSSSGYGSGPENNSSNLADSVPAMMFTSASSTFLTFKPKQSMHFTFLTIGSRGDVQPYIALAKGLQADGHRVKIATHKEFKEWIESHNIEYGYVGGDPAELLSLCVENGTFTVAFLKEGLLKFRGWLDDLLKTSWEACQGTDVLVESPSAMGGYHIAEALGIPYFRAFTMTWTRTRAYPHAFAVPERKMGGSYNYMSYVMFDQVFWRAISGQINRWRRNVLQIESTSLDKMEPHKIPFLYNFSPHIVPPPLDWPEWIRVTGYWFLDDADVSSKKWTPPGDLIKFIDSVHSADKKVVYIGFGSIVVSDPKAMTKCVIDAVVQSGVYAILSKGWSDRLHVKSPDTGEVEDPLPPQIYPINAIPHDWLFKRIDAACHHGGAGTTGASLRAGIPTIIKPFFGDQFFWADRVEALGVGSGVRRLTVESLTEALRNATTDQKQISRARVLGEQIRAEKGVETAIESIYRDLDYARSLIKRRNAAPESDGDDTDNEHATVRDRHPLSSASEPRSGYSSSGSVQGAPSEDWSVISDSRRSSVSSAHSGTSEPGSNSGKRSTIAAAMLSVLPNSLTPGSPRKRTLSANSQS

SEQ ID NO: 7991 - protein, 802 aa, Botrytis cinerea
MADSKLYEQEHNQADSPPSYGEATLSDTLLFSQTTKARGRSPCDIPSENRPWAVKLNIVIQVVGSRGDVQPFIALGNELQKHGHRVRIATHDQFEDFVRQANLEFYPIGGNPAELMAFMVKNPGLIPSMQTLRSGEIQRKRATISEMLEGCWRSCFKPDMISAEPFVADAIIANPPSFAHVHCAQALGIPLHLCFTMPWSPTAAFPHPLANIKTSSVDVGTGNYLSYLLVEWMTWQGLGDIINSFRERIDLEHVPYSEGPTLAVSLKIPFTYCWSPALVPRPIDWPPHIDVCGFFFRDTPVYTPPPELDAFLRMRGPPVVYIGFGSIVIDDPEALTGTLLDAVHALGVRAIISKGWSKLGGADFEDIFYLDDCPHEWLFQHVSAVVHHGGAGTTACGLSNGRPTMVVPFFGDQPFWGEMINAAGAGPTPVPFKSLNTKNLVEGLKFCLTKEAAIAAGKIASKMVKEDGVKAAVRSFHANLPLEDLRCDLLPDKPAAWRYKHKEKTIKLSKFAMQILLENNRLDQENVKLLETKHIDILHRRWDPVTAMASAYIGIATDIVQAQVGVFTKPYEEYKKAQAQNKSRKIVDESLSKQDPEVSDSHSLPGGNGAMSSSSSIHSTNSHNKKSGTAGLMARASGKSAGKMFVATGKGFFVNVPLAMADGMRAMPGFYGDKAKDCGNVTGWKSGMAAGGKAFSYGIVGGLADLVVQPYKGGRKEGALGVAKGIGKGTLGMISKISGGAVGFYAYPAQGIAKSISNTVHTTKKKEIQAAKREEGAWLIQEGRLTNEDVKVIIDVFEFIKI

SEQ ID NO: 7992 - protein, 1468 aa, Colletotrichum fioriniae
MASPAPAGAASVSFGEDDVKKRVGKKLQKKRHESNTPAMELPERLKEGDDSREEDLVPQQGPPMFMNMNQSIFGLIAAAGSRVDFHDRFESSDEESADEDEPTRRHGADKLDGGDDKVHGGIGHLLHRKQRRQNDSDLSKTTVLKKDSSSKTEKHRRKISGSKLLRSLPALPRLPRHKSKKEPSKLEPTSEEASDTSEPSPSQPADDTREDDDQDGHRLAPVMSRMLEAKAEMSARPSFDVDRRSSDQLNYSDSGDSNSTALARRLQDIFEFDHPEAVIEEYPCWLLQSVLLQGYMYITAKHICFYAYLPKKAHEVVKSGYLSKSGKRNPKYNRYWFRLKGDVLAYYKDPSNVYFPSGQIDLRYGISASVNNNKDGLTFTVVTHHRTYHFRADSAPSAKEWVKSLQRVIFRSHNEGDSVKISLPIENVIDIEDTQMLEFADTCKIRVIDNDETYAIDEYFFSFFSFGKDAISVLKILIEDASSSAKDAALLKAAQAQEEQERQERQPVPASARSSMSASRRMAPPKLRTTKLPDAVKATLSPLSAHSPSTLSPRASMDAARASFDAFRGFRRRSLDLSTIIRDSSPRRSFSGNRRSMSRNRLDDSRHGTHKQGSTDSYVQSSMEDPSYSGMVASSNEDPSASQILRGSDVFQNPTVRRSASASRTELEKNQRRDNRSPPALAAYSGQHAATTGSINDGDKPPVTPTLQSITKMGAFPLQRVGAFAQYLNSTSGKLGSMLATESMGYVEKVSGMWRGGRKHYDAPPEIKTDDEDLYEDAEGKIQTSMDRFRAHFALPETEKLQATYFGYILRVLPLYGKIYISDKSFCFRSLLPGTRTKLILPLKDIENVDKEKGFRFGYSGLVVVIRGHEEVFFEFGQAELRDDCAVTLLQSLETTRYLKESGDLDLDEKEEEENAMAERDALKEARQVEEFHDHELRLPKEGSGVSDAPTILFDDPKASFLNFKPPHSMKITCLTIGSRGDVQPYIALCKGLIAEGHKPRIATHAEFKDWIEGHGIEFAKVDGDPGELMRLCIENGTFTWAFLREANSMFRGWLDELLVSAWEACQGSDLLIESPSAMAGIHIAEKLSIPYFRAFTMPWTRTRAYPHAFVMPEYKMGGAYNYMTYVMFDNIFWKATAHQVNRWRNNTLKLPNTSLEKMQPNKVPFLYNFSEYVVAPPLDFSDWIRVTGYWFLEEGTDFKPPQELVDFIAKARADEKKLVYVGFGSIIVNDTAKMTQEVIDAVQKADVRCILSKGWSDRVAKQGEAESAKDEPIIPPEIFVIKSAPHDWLFSQIDAAAHHGGSGTTGASLRAGIPTIIRPFFGDQFFFGGRVEDIGVGICLKKWGAVSFARALWEATHNDRMIVKARVLGEQIRSERGVENAIQCLYRDMEYATSLIKRKAGKHAHAEEDEDEEVEESWTFIGNDEPDPDMTTKKLSEMGALPGLPGDKPLGNRVMRVSPSPSQQPVA

SEQ ID NO: 7993 - protein, 762 aa, Fomitopsis rosea
MSDITTPSKDGGSWMVGVPSWLRMPSIPSRRTLTSAFGIRSGETRSMPESEGVSEVLSSNTGTGSRMSASSSSPNDFGYFSVLEAPTTLDGDSIEKFRSAFALDEKETLLGVFPGYIYRLLPVYGRLYVSTNFFCFKSSGPLTTRTRMILPIRDILSTEMSKAFHFGHYGLVIVVRGHEELFFEFGDEERRAAFASLLERQMEDERRRSPGTDTSGSTPGRHDTLILDEVGPRLPSDTAKKAMYDGSMSESLPAVMFNSASSTFLTFKPDKSLHFTFLTIGSRGDVQPYIALAKGLMKDGHRCRIATHGEFKDWIEAHGIEFGYVGGDPAELMRICVENGTFTVAFLKEGMLKFRGWIEDLLKTSWEACQGTDVLIESPSAMSGYHIAEALGIPYFRAFTMTWTRTRAYPHAFAVPGHKMGGNYNYMSFVLFDQVFWRATAGQINRWRRDTLGLGSTSLDKMEPHKMPFLYNFSPVIVPPPLDWPEWIHVTGYWFLDDADVSSKKWSPPADLIIFLDSARKAQKKVVYIGFGSIVVSDPKSMTRCVIDAIVRSGVYAILSKGWSDRLVDATDVAEPEEPLPKQIYPIASIPHDWLFQRVDAACHHGGAGTTGASLRGGIPTIIKPFFGDQFFWADRVEALGIGTAVRKLTVESLTQALVTATTDQKQITRAKAVGEKIRAEDGVGTAIEAIYRDLEYARSLVKGAAADDLQDDDGLDAEHATIRDHRQSLPSPEYSGARSGSSSISSAQDSPSDWSVISDQE

SEQ ID NO: 7994 - protein, 1413 aa, Gloeophyllum trabeum
MSTPEDSVLAEKDDELSTSKGLVQRAVDRLGRAKSIGSRTPSSTQSAVSVAPRRLFSLHRKGKSREESSGLTLGMSEGDLRGPQSPPLTPQGGPSDDSPFIRPPSPPPTSRLSRSMFQLFRGDGSIRGGTHAIIQALGAIPFTEDQETDDDLGNHHPTQVESDSEPDENTDTPMTSSLHTIHRPLDKSRRGATALRNVFSVRSESPEEEKERETLSSSETDDADFEVDTPRMPDYTPAGLTSSPISTPSIHRGRVDGPQSSITRSGSMATVRLQRRARLADKLKDIFDLEGIDEVVAEIPCWLLRTILLQGYMFLTNSHLCFFAHMPSRENQTLKSGSLSKKAQRTKRWIKHWFVLKNDVLSWYQSSSDPYFPHGVVDLRYAISVEPVKDKEFRIRTNQKTVLLAADSPSSRDEWVKAVHKVMFKAQNSGDSVKIAIPYSAIVDVEKSSALDFSETIEVKVIDRDDSVVDSYFFAYFHDLDTALEQIRDVIRKYRTVPQGSSPQPIMDTTTPRLLNVPSQPADQSAERTHSLPVADHLTRAYSAFRLPSIWPVGRTTSAPQQSQSTVDDNEDFTHISKRKSGSSFVPFTTSPKGEKSQLPSADSDGFEGSSHVSSSVSSNHTYPPHPSPSESFHAAGADHTGGLWGVPAWFKVPSKRMFTSSFVSESYPTSTSPSARHGELGFSVLDKPGAAVDADMQEKFRTYFAFDERETLLGYFPGYIYRLLPQPGRLYISTNYFCFKSTGPLSTRLRMILPIRDILAAQKSKAFHFSHYGLILIVKGYEELFFEFRLEERRRAFISLLERQMDVVQSQEGSNPSSPGRSDALILEGFGSRTSLVQTSDSRPPPESMDQSVPAVMFTSSSSTFLTFKPKESLHFTFLTIGSRGDVQPYIALAKGLMADGHRARIATHGEFKEWIEAHGIEFSCVGGDPAELMRICVENGTFTVAFLKEGLLKFRGWLDDLLKTSWEACQGTDVLVESPSAMAGYHIAEALGIPYYRAFTMTWTRTRAYPHAFAVPEHRMGGNYNYMSYVLFDQVFWKAISGQINRWRRNVLRLGGTNLDKMEPHKVPFLYNFSPTVVPPPLDWPEWIHVTGYWFLDDAEVGAKKWSPPPDLLEFIDSAHNAGKKVVYIGFGSIVVSNPKAMTRCVIDAIVKSGVCAILSKGWSDRLQVKNPGEAAEVEEPLPKQIYSIASLPHDWLFKRIDAACHHGGAGTTGASLRAGLPTIIHPFFGDQFFWADRVEALGIGTGVRHLTVEALTAALLAATTDEKQIARARQVGEKIRSENGVATAIEAIYRDLEYARSLVKKPHEEPDGEIATIRDVEPPSSSASGSTPERPSTAQSSVESVDGNASEDWSVISDGGMSDGPHSRPDMRRRSSLGAAVLNVMPNVMRRSSSPVTGNGSGQANLPRCR

SEQ ID NO: 7995 - protein, 366 aa, Micromonospora sp.
MATFKIPFVPVGPPWRRSAAPRPRAAVPRPSPAQVRQLAESSIGIQFEVLSAAARDCDAVVASTGLQIAARTVAEKRGIPYVFTAFCPAALPSPHHAPLPLPALGEVPAPASADNGELWAANQRHVNDTFGAPLNALRATIGLGPVEDVSAHIHTDQPWLAVDRTLAPWPDAADRTVYQPGAWLLPDERALPPELATFLDASDEPCVYVGFGSVAAPPGLLETAVKAVRAVGCRLVVSRGWAPLSLAVRAPDCLVVGEVNQQELFKRVAAVVHHGGSGTTTTAARAGTPQVVIPQVYDQHYFARRVSALGIGGAHSGAVPTVESLTAALSAALRPEVAARARAFAAAISTDGAQLAAERLTTTLRS

SEQ ID NO: 7996 - protein, 1509 aa, Apiotrichum porosum
MTDYGSDSLTASVTANAVPQVVPDTPDLAGTEEGRASPPPPSHADASPSSSSALVSDPVAAERASDPTETASPDSSGSRRPTISLLSRTLEDMSPFMDEPHKAYESPPPVTSPLPGANDDTRPKTASEATPPVRLPQPPRSSTFHGSLIREGSQDSLAGMGSIRVGTSALVSALTALPWDNDTDDDMSAADEDGDAHDTARMAKTSVLPTRPKIHRLNSSLHTIRAMDLPPFVDNDDDNTPVATKSSSHSFHPHRQKLHFPFKDNTIARRARSPSKTELDYQLARKKRSEGGGGYHSGEGSHDERSPLHSGAESEPVEQPAPSDTDVEPRPQETRPESLPDLQHTDTETRLSEHTKIIRKDKLAARLQQVFGLDEQEEVLEEMNCWLLRNFMLKGYMFLTRQRICFFAHIPVDENTVIRSGPLWKKSSQTKLSTKSWFVLRNGVLSWFESSNDPYFPKGVISLQYASTCDSVGGARFKVRTTERNYTFIADTVDNAAEWVKAINKVIFKTQHEGNSVKLIIPLDAVVDIEQSPTLEFAETIEVKVVDPDDSMSVESFFFASFPDTDYAYEVLQKLLQDRPSSTLPQVPSTTTLHATADNASDHSVPRPGSSASGQFGLPKIGTVLRPLGLGGEREGKASSDSRVPIAAPPKPTLPHSHSDTDFVTSESEASDYETSGPKGYPPKQSGPPPPSMEPASSWRGGSWIRNPAAKLFGTSPSSAELGKRFSINQDPPRRPSNVTVVVEGALPNSDDEASDHPSNHRLHPASTMSSTMTISSGQSKIPHSKSSQSGFETVDDNVSSKFHSYFALPEKEELIADCSGSLYRVIPVHGRFYISTNYFCFRSNHLLYKTKAQKAFRFAHSGLIVIIKGHEELFLEFSSSKRRNDCMSLLEDRMEALREGNLPSHTPDEFPETIMEDLDESLWRSGPSAASLPSPMFGSAASSFLEFKPEPMTIVCLTIGSRGDVQPYIALCKGLQAEGHCCKIATHGEYKDWVEAHGIGFASVGGDPAELMRLCVDNGMFTVSFVKESLGKFRAWFDDLLTSSWAACQGADLLIESPSAMAGVHIAEALQIPFYRAFTIFWRAMAGQVNRWRKNELHLDATTLDKLHADKIPFLYNFSPTVVPPPLDWTEWIHVTGYWFLDHADGPDRKAWTPPEGVVEFIDAAHARGKKVVYIGFGSIVVSDPHEMTRCVVEAIVQADVCAILSKGWSDRGNEAASKGNKDGADGIEYPDSIFAIDAIDHSWLFPRIDAACHHGGAGTTGASLRAGIPTLIKPFFGDQAFWAERVESLGVGAAIRKLTSESLATALREATTNERQITRAKAVGEAIRKENGVQRAIEAIYRDLEYAKAIIKPLPGASDTSLVRKVSHFGLHSVPPGTPRKSKSLREPRSEGHGRAHGHSHSRSRGISTDREGGPGSDESWSVVSDSGHASQMNSPAIHISQLHDGGSDPSTHSCPTPAEGGSGSGGAGRRESSFAALGNLMGHWLPKSATPRGPPTPEPAETSEDK

SEQ ID NO: 7997 - protein, 1462 aa, Zymoseptoria brevis
MANKTDKQAASQASALATSSSTSALAPIKSRTASRTHAPRIPSPEPQRLSLDLPERFRFDSAEEDDVDDGTGVNEDDSRIGKGLFPQHSIYGLLAATQPSLGPQATSPSKRGGSSIKSRIGRTGLGAGFGIDRESDSESGSDDGNQVEDEDIRNVAAGTASRAAKPRSGHRKRLSENKLVRKVLRPICERADSQDLMTQSQFLPPRKKMAEDSEKQRISPPRKKSSSATDLKREAAKPSSPITIKQSRERSESPEPPMVHEEIDDEPKSLPTVLAQMFQFEQEEEVIAEYSCWYTVNVLLQGKLYITGKHVCFYAFLPKRHNKIIKTGHIGKVGKHSYRYLRYWFLLKGETFSYFKDSHDPYFPLGVVDLRNGISADITTKAGEDTTEFTLTTQTRVYKYKADTPGSALEWVKQLRKVMFRCHNDGNAVKVSLPLENIVDIERTGVVKAAETIKLRVVDNEETFAVDEYFFTLFQSGDEAWNMLKDLTDGNNAKQMGSDAALQDARPFGKTKSQKSEKSSTLNKDRYLVAEPVRTTLSRPNIRAPSSPRRSIEQQRSSTEASRRHSGETSRASVGRGRRSVSATSRTSLDASRVSRSPLSPVNQESESESLTMSSERTTGDEIDASMSASQMLSNDVVFRGPTLRPSHSRQTVSGATVEKLPKESEDLSSSRESSRERLPVRPSTKPRTEQALPVLHRSESSGSIKTLTANDKPARLTQGLMIRGISTPLQHAMNVAGMVHTTSKRMSSYLSSSPKDYLGKFSGALAGGKIQYDEVEDLTPDDSVRDTERDASGLTAEDRFQRHFGLPPTEKLTCAFYCCLIKTVPVYGKIYMGSRHFCFRSLFYGTKTKIVIPYRDIINVQKQRGFRWGHPGMCLIIRGYEELFFDFSNKGLRDDCAIRSLRILDAMRNLAEDPALLTDDELRDAAEAAAENNTLQTAKKQNLNTNELQMAVDATNDDPDAPPILFDDDLSSSMLDFKPKEPMNITCLTIGSRGDVQPYIALCKGFIAEGHRASIATHAEFGDWVKSHGIEFKEVAGDPAELMRICVDNGMFTPAFFMEANSKFRSWLDGLLITSYEACKGSDLLIESPSAMGGIHIAEALQIPYFRAFTMPWTRTRAYPHAFAVPGRKLGGVYNSATYTIFDGVFWQAMSGQINRWRRHTLDLPPTSLSRLQQDKVPFLYNFSPSVVAAPLDFADWVKVTGYWFLDEGTKYSPPPELADFISRTRAEGRKLVYIGFGSVTVADSRQLMQQVMEAVRKADVNCILSKGWSDRFSKTSSTPDAPLPDCIHQIRSAPHDWLFTQVDAVVHHGGAGTTGASLRAGKPTIIKPFFGDQWFFANRVEDLGVGSHLKKVSANQLGKALWVATHDARMMEKAKVLGEKIRSEDGVGEAIKAVYRDMEYARSLVTVKKQGVKKGGKGWWAGGVWGADGDEVEGEEGGDGGEEDEMWELVDDEKESEAEE

SEQ ID NO: 7998 - protein, 1564 aa, Pseudozyma hubeiensis
MHPRTLATIASSSRAGSPRISENEASTSTSQATQPNEADLDPFTVEDEDGERPQVPPPVQVPVDLDTPPLPTSPRLDPWTPRDISTISSLAGSRELGRPALEPITRIFAPNSASSQSARQSASTVNEPAVDVDQHGVADVAFHAEPQGLMQMLSLVGSTFFDADGEGYREDDEEESEQPSYQPATASTNLYRQTILDDAIGDSPTDESQPHVSDHTKLILDRTAKGRLQALARDDVSDDGSTPQGSRSPLDASVATIGPKRSKRTSLTHSEIISSSRDSTATRTTRRPGNPRSHLHNVASASMFGSTSKLAGDADDDQHGSRSIYGSSPPDQGSTDTQQARLSQQPSVVRLPSDAGQPIDRDSDPLLIRPYQTASPSRLATVDVSDSARIRLLHQLKEIFQLDTAETLLLAQPCWLFRSLLLQGHLYLTSSHVCFYAYLPSRDEKTVKTGLLGKRTRRTHRFSKHWASLKGGKLSWHDSDRDPYFPQGHIDLRKVSAVEPSTSHKDRFKVTTPARRFTFLAEDEHSRDAWVTALQKETFRAQNQGDSVRISIPLETVMNVETTLSVEGTEMVCITVVDEAGDFSVDEYYFLHLTKPSAFISGLTALLDQMGRASVASLQGGDQALNLSRLSIRDSTGATHATSISRKSLEEVPVLAKVLVPSQPGDQDARRGEAEGTKISQTEPAARAAAGLIWRQSADQGDESTGSASTAAAAVAIPVSVRGTSQEGSTDAVLSTTPRAAALKRLSTESSHTYPPSPSASDPPSSFDDVQKEAERGWAIPDWLKAAPARVLGRVTDSTSAASPAKTPWKDPGTRRRRRVLEKWSDEKGDDVSRGESSNTDNDDDTLSHSMHSTQSSYSILDADDGAAAAPDHTSVAAEFRDTFGVGDNEGLIGHTHAYLYRVLPIAGRFFVGEHHLAFRSSGIAAKTVGRTLMLVPLQEVISAAKHVAFRPGHHGMVINISGHEELFIEIASAHRRDELLSLIEYQLELLRGGRGSRASRESATRERSHALVLRDLSERIHDGAAATSLASSADSSMLSPTGSALGGKSSNLSQLGEGSSVLSFAPTAPLTFTMLTIGSRGDVQPYIALAKGLLADGHRVRIATHAEFGDWILGHGIEFSEIGGDPAELMRICVENGTFTVSFLREGVTRFRDWLDDLLASAWRACQGSDVIIECPSAIAGIHVAEALQVPYFRAFTMPWTRTRAYPHAFAVPNKKAGGNYNYMSYVIFDQMFWRASAFQINRWRKKQLGLQPTNFDKLEQHKVPFIYNFSPSLVPRPLDWFEWIHVTGFWFLDNPDNSESKKWEPPGDLVAFIKRARDRRRKVVYIGWGSIVVPDAVAMTKCVLQAVEKSGVCAILSKGWSDRLSSDRSAATDLGVGEDVYQVTSVPHDWLFPQIDAACHHGGAGTLGASLRAGLPTVVKPYFGDQFFWGQQIESLGVGSCVRHLTVDTLAQALIKATSDKKQIERARRLGEQIRGEDGVGTAVKVIYRDLEYARGLVKKDTRIEGSAKGRNVAESGKDGGLEVEKTQEEDEGHTSDEWSDIGGGEFSPRGSEGPSSSLILG

SEQ ID NO: 7999 - protein, 371 aa, Haloterrigena turkmenica
MAKTNVVAAFTDLYRPTVNGVTYTVALWRERWTRRRGSMAIVFPEMDGYEPGDGEYALPSVGAPLYPRYRLGVPVAPDGLDTPDIVHVHTPFTVGFAGVRFARERDVPVVATYHTLLEDRVNQHVPDGAVEPLKRVCRAYERAFFERVDHVTVPTSFARWHLLERVGADIDATIVSNGIDVDFFRPVESTPVRERYGLSGEGPLLGYTGRHGPEKNLEEAIDAVDGTDWTLVIAGDGPARDDLEGRAAATDADVRFLGFLEREELPAFYSALDAFVFPSPVETQGLVALEATACGTPVVAADAGALADGVIEGETGYRYAPGDREAFRWAIRRTLAERERLSDLCRRRRDMLAVDHSLEQLAALYDAVRDD

SEQ ID NO: 8000 - protein, 404 aa, Leifsonia sp.
MGADTFSPDVNGAARFAERLASGLAARGHDVHVVAPAASRKHGTWTETYEGQDITAHRLRSYRWYPHDWLRWAVPWRIKQNSARILDEVKPDVVHFQSHIVTGRGLSVEAEKRGIRIIGTNHFMPENMLEFTGIPKPMQEWAIGLAWRAARRSFVRAEAVTSPTKKAAEFLEKYTGLTGVHAISCGIDADNYTPDFEPRTANRIVFVGRVTGEKQIDVLLRAMTLLPADLDAQLEIVGGGDQKKNLEHLAETLGIADRVTFTGYVTDDELRQAYTRATVLAMPSIAELQSIVTMEAMASGLPIVAANAMALPHLVHDGENGYLFTPGDAADLADRLERVLRAPAEQLNAMKSASLKIVAAHDIKRTLSTFESLYRGEPVADPVMDAGSPVPTAEKRPGGGSSAG

SEQ ID NO: 8001 - protein, 385 aa, Natronorubrum texcoconense
MTYPQITVFTDSYLPTINGVTYTVRNWRDRWLERGGRMAVVFPNAPGYDPRVGEHAVRSVPFPWYDGYRLGWPRVPASHDLSRADVVHTHTPFGLGLAAQRLARRADVPLVASYHTPTAEYARYLLPSDRLRSVEGLARRGALAYERRFYDRADVVLAPSETTRRYVRESIGISTPVRVVPMGVDLERFRPVDTSAFRDRHGLDRDTPLIGYTGRHGHEKRLEDLLDAVAGAADRTDTPLESATLVLAGDGPARPSLERRAAALDFDVRFLGFLDRSELPAFYSMLDVFAFPSPVETQGLVALEAIACGTPVVGVDAGALAETVSGGETGYHYRAGDLTGFRRVLERALDERSELASQCLERRESIGLERSVDRLRDAYASVSGR

SEQ ID NO: 8002 - protein, 373 aa, Halobellus sp.
MPPASVAAFTDTYLPTVNGVSYTIQTWRDRWRDRGGTMDVVYPGSDAYDPDDGEYPVGSLPFPMYEGFRVGTPRVPGAVEDVDVVHAHTPFAVGLGGVRLARREELPLVTSYHTPTAEYADYLTSRPRVERGIERIAERYERWFLSQADAVVCPSEDARERAVGNVAVDTPAVVLSNGVDVEFFAPTDAAAFRERYGLPSGPLVGYTGRHGYEKNLAEFLRAAAGVDATVVVGGDGPARDDLETLAGELDLDARFLGFLPREELPAFYSALDAFVFPSPVETQGLVALEANACGTPVVAVDAGALSNTVDDGVTGYHYTHGDVDGCRDAIRRVLDDRASLAESCLARREQLSVEHAVERLSSLYADVVEKTQS

SEQ ID NO: 8003 - protein, 673 aa, Amycolatopsis benzoatilytica
MTIIAICLAVVGAAFFSVGALLQHRVVAGLPGQPRIGLLVRSPRWLGGLALLGSGAGVHAVALGMAPLSVVQPVGVLAVAITAVLNRRWRDLPAVALTTLGVGTFVTVAADRASTTPVSADAQLRAAFLVLGIVALLTITGAVSSRPAVRGMCFGAAGGAAYGFVSVLMRAVSLEIREGTVSFATAASVAAMVVALAVGGWLVQLAYRCGPPHAAVACLTVVDPLVAVGLGAGVLGEATHLDGGETAVALAAAVLAVGGIAVLSRTGTTPVHFSRSEHPVNDDRALRIVVAAETYPPDVNGAAHFAHRLATGLAGRGHQVHVITVDPAGVARTERAGDVVVHRVRSHRTPFHRTFRIGLPWEVSKDVAVLLDELRPDLVHVQAHFVVGRYVLKHAAAMGVPGVATNHFMPENLFGHLRVPTWLRGAASRWAWRDLTRVFSTARVVTAPTPRAVELLHENGFPERAIPVSCGIDIDRYRLRTFSRVSDGPTVLFVGRLDEEKRVDELLRALALVPDLRAEIIGDGSCRAQWEALAGDLGVAERVRFRGFVSEEDLLDAYAAADVFCMPGIAELQSLATMEAMAAGKPVVVADAMALPHLCRSGYNGWPFQPGDVGELAARLHAVAADPETRARMGAASGKMIAAHAVETTLDSFEACYATAMGRAERVPAARAA

SEQ ID NO: 8004 - protein, 407 aa, Nocardiopsis alba
MAQSARPLNVLIASDTYPPDVNGAGYFTHRLAEGLAERGHHVHVLCPSDEGDPYVTVNGAVTEHRLRSAPIPFQQHMRAALPLGMGGHITRLLGRLDPDVVHTQSHFTLSRSALRRARAVGIPVLLTNHFMPDNLYAHARVPRPMQRVAGAAAWRDMVRVAAEADHVTTPTPRAAELLREKGYAREVEAISCGIDLERFHPRPRDRARARLRFGLPDRDTVVFVGRLDEEKRIGDTVRALARIVPERDAQLVLAGTGQCEEELRALAAGLGVGDRVFFLGFVPDEDLPLVYAAADAFAIAGVAELQSIATLEAMSTGLPVVAADAMALPHLVEEGRNGFLFPPGDDALLAERLVTVLGPERSRFGAASREMALGHDHRRSLERFERVYESLRGRGTLRASSHRSLVA

SEQ ID NO: 8005 - protein, 433 aa, Marinactinospora thermotolerans
MTALPPSPQTSPGRPAGPALRILIGTDTYPPDVNGAAYFTHRLAVGLAERGHDVHVVCASADGPPHVERAEGVTLHRLRSSRVVPHSPMRVAVPLGVDGHLSRLITRLAPHAVHSQSHFTISRAVIRRARAAGVPVVLTNHFMPENLFAHAHIPPRLQAVSARLAWRDMMRVGLQADHVTTPTERAARLLREQGFARPVEVLSCGIDLERFRPRGQERAAARVRLGLPERDTIVFVGRLDEEKRIDELIRALREVLRHRDVQLALVGTGQREKELRALAQEIGVAGRVHFLGFVPDEELPLAYVAADLFAIGGIAELQSIATLEAMSTGLPVVAADAMALPHLVRPGRNGHLYPPGDVATLARHLLDVLESPSRRAEMGAASREIVLQHDQRRSLDRFEELYARIRPRRSGTSPHGAAPLTRVPLRRDNGMAA

SEQ ID NO: 8006 - protein, 442 aa, Halomonas ventosae
MNVLMFTNTYLPIVGGVSESVQRLKRQLQAAGHRVLVVAPRLSGQPRREDDVVRVAAMQHFNGSDFSLPVPIPGQLHEAIEAFDPDIVHAHHPFLLGDTAARAAETYGLPLVFTHHTLYEHYTHYVPGDSPRMQRFAVALATQYTWLCDEVIAPSESIRDLLLHREANPRVSVVPSGVDTARFAIGDGAGWRERLGIPEAAYVIGHLGRLALEKNLGFLAEAVSEALVREPGAHFLVVGEGEARGTIQALADARGVAGRLHFTGRLQGQALIDAYHAMDVFAFASHSETQGMVVAEAMAAGLPVVAIDAPGVREVVVDSRNGRLLAADDVDAMAGALAALADPGVRLPLAEAALATAAEYDEGRCAARCLAVYRRAIARGGPFTHADEGGWERMRHRLGAEWQMLRHRGRLLRHLVQEEWEQERPAWWPGHRAEDEREMPPK

SEQ ID NO: 8007 - protein, 431 aa, Kocuria rosea
MSAHTASAARPLTVLLGAETYPPDVNGAAQFGHRLARGLHEQGHRVHVLCARPDPGPSYRAEDDGVVEHRLRSHRAFTHPYFRLCFPWQVAGEIRRVLDEVRPDVVHVQCHYILGRMLVREARRRGIRTVATNHFVPENLEPFLPFPAWVLNRYRAVSWRDMVRVFGACDVVTAPTPLAVEAMRRNGFPDTVLAVSNGIRIADYEAHDGERRQPAAHPTVLFTGRLAVEKNVDVLIEAISVLPAELDAHLEIVGDGEQRPALEKLARALGVAHRVRFLGYVPDEGLRAAYLRADVFCQPGTAELQSLVTLEAMAASRPVVLADARALPHLAEDGVNGWLFAPGDAQDLARKLALVLGAPREERARMGRESRRKVAQHSFPRTLETFLRLYRGEHPESVRTPAPGAREHQESARAPAAGPRRIRTRLASLVR

SEQ ID NO: 8008 - protein, 409 aa, Nocardiopsis lucentensis
MAQTNRVLRVLIATDTYPPDVNGAGYFTHRLAEGLAGRGHRVHVVCPSDLGDPYVTANGGVTEHRLRSAPIPLQESMRMAVPLGIGGHTARLVARLDPDVVHVQSHFTVSRTALRRARAVGVPVVFTNHFMPDNLYAHAHLPQGVHSVAGSVAWRDMVRVAGAADHVTTPTPRAARLLREKGFARAVEAISCGIDLERFHPREGERAAARARFGLPDRDTVVFVGRLDVEKRIDDTIRALARVVSERDAQLVLAGTGQREQELRALAAGLGIADRVRFLGFVPDEDLPLVYAAGDVFAIASVAELQSIATLEAMSTGLPVVAADAMALPHLVEEGRNGFLFPAGDVAALAEHLLTVLGPDDRRRAMGAASREIALRHDQRRSLERFEAVYTSLGAAVPAPVRVERVIAA

SEQ ID NO: 8009 - protein, 439 aa, Halomonas sp.
MPRKARKPLSEAEIDQLMLLARGNAMARQLRAERAAAPTSRHLACHRGGDATLKILMISDVYFPRVNGVSTSVASFRDALERLGHAVVVLCPDYPVGQLEEPGVLRIASRGVPGDPEDRMMRLGELLALGPELEEAGFDLIHVQTPFVAHVAGIRLGRRLGIPVVATYHTLFEEYLHHYVRWLPQRWLRFLARRLAVHQCHQLDALVTPSHAMREALLRYGVTAPMTVIPTGLALESFAQPAEACDFRSRYDLPANARLLLYVGRTAFEKNIGFLIEMLPRVLARHPEARLVITGEGPAREALARQAREAGLADAVIFLGYLGRDGPLQAAYRAADLFVFASRTETQGLVLLEAMALGTPVVSTAVMGTREVLVEGEGCLIAEESHPDFAAKVNRVLADDTLRRRLAERGRVHAAGWHEDAKAAELVMLYRRQSLSVPE

SEQ ID NO: 8010 - protein, 386 aa, Unknown
  Description of Unknown: Clostridia bacterium sequence
MRIGFFTDSYHPYTSGVVRSLEIFQEELRCRGHQVYIFAPNYPDCPPEEDVFRFFSIPAVTQKNFTLAVPLSPTLSRRVKSLELDIVHVHSPFLLGSVGARWARRLGLPLVFTYHTRYEEYVHYFPFFPQVSRPVVRYYVRDFSNRCNLVVAPSGSMAEKLQGDGVRSPVTVVPTGIRYARLQGGEPGWLRHRYGIPEGVPVLLYVGRLAREKNLEFLLEAFQQILRQEPECRLVMVGSGPAREELVRRAARLGVAGRLVFTGVLPPPEVANCYQGADLFLFASLTETQGLVLVEAMAAGLPVVAVQAGGVTDVLQDGRQGFISQEKVQDLAAKALLLLRDPELRRQMGARARERAQEFTAERCTDRLLAAYNLVLTQETRFSRAG

SEQ ID NO: 8011 - protein, 404 aa, Unknown
  Description of Unknown: Candidatus Rokubacteria bacterium sequence
MAAEHQAGGFREVQQGVTDTPVRVALFTNNYLPFCGGVTVSVETLRAGLEAAGHEAWVFGPRLAAAADGSPRVVRYPSIPAATYPEFALAVPYSRRITRLVASLEFDVFHAHHPFLLGPAARRLARRRRRPLVFTYHTRYEKYAHYVPLRRPLVEALAVRLSTRFAARADAVIAPSAVIRDELQARGVATPIAVVPTGVDLSRFRPGDRGAARAALGVPGDDPLLLYVGRLDREKSVDRVLLAFERVASTLPAARLILVGRGTEAARLERLARSLPVADRIRFCGARPHAMLPSCYQAADVFLFASETETQGLVLVEAAACGLPAVAVSGPGCEEVVRDGDTGILTKGEPAALAEAAIGLLLDPARRQRMGARARGVALREFDVHFQIERTLAVYAAAALRMRE

SEQ ID NO: 8012 - protein, 386 aa, Saccharomonospora marina
MRVLIATDTYPPDLSGSSFFADRLAKGLAERGHDVHVVCASETGPRQDVRDGGVRLHRLRSLPLLIHPRVRFVPPPGVPLIVRRIVAAVRPEVVHTQDHFTIGRAAIRAAQRYDIPVVATNHFMPDNLLPYLPRRLHAPVADLAWRDFRRIYRRTDYVTAPTPTAAALLAEHGFARHVEPVSCGVDTVRFHPPADSAAAIRKELGLPDLPTIAFVGRLDAEKRIDELIRAFARLRHLDAQLVLAGEGTRRPELQRLAEQVGVGPHVHFLGFVPDEQLPSVYQAADVFAIPGIAELQSIATLEALASGLPVVAANAVALPHLVSPGENGFLVEPGDVAGLAATLDRILSYEELRRGMGTVSRSIAVSHGHERTLARFEEIYRAVTAG

SEQ ID NO: 8013 - protein, 380 aa, Unknown
  Description of Unknown: Candidatus Rokubacteria bacterium sequence
MRVALFTNNYLPFRGGVTTAVETLRRGLERLRHRAWVFAPASRPPVTDPPWVFRYPSIPAPTYPGFALALPFSRRLHGTARALAPDIVHAQHPFLLGPAARRFARRHGRPLVFTYHTRYEKYAHYVPLPERLVAALAVRLSCRFAGSADLVVAPSERIATTLRERGVTAPVAVVPTGVPLDLFRPGDRAEARRKLGLPADALLCLYVGRLDREKSVDRIIDAFGSVTDAIAGARLSLVGQGAHETAARRRAEASPARERIWFHGGRDRDTLPLFYRAADLFLFASETETQGLVLAEAHACGLPAVAVRASGVDEVVRDGETGLLTKAAAREFADAAIGLLLDGERRMAMGRAARAVAEREFSAARQVEAMVGHYGRLLQT

SEQ ID NO: 8014 - protein, 456 aa, Halomonas sp.
MPQRRRPYLSSPLSDPELAALTQLANGNALHLQREADRKARLASTLTLFHPAASTTNMPQSGMKVLMISDVYFPRVNGVSTSIASFHGALERLGHSVTLICPDYPVGQVDEPGVLRIPTRRVPGDPEDRMMRYRDLLALAPSLAGEAFDLIHVHTPFTAHYAGVALGRRLGLPVIATYHTLFEEYVHHYIRWLPRRWLRLAARRLSVHQCQQLDALVAPSRAMQETLTRYGVTTPSTVIPTGLSLESFCHPQGAQDDSDFRAHYDLPTDARLLLYVGRAAFEKNIDFLIDMLPKVLAEHPTARLIITGEGPAHDSLVRRAQEVGVAESVLFLGYLDRHGPLQAAYRAADVFVFASRTETQGLVLLEAMALGTPVVSTAMMGTLDVLKEGEGCLIAEDTHDDFAAKVNRLLRDNALCQQLAKRAQAYAASWHEDAKSAELVSLYRQIAAESLARGSK

SEQ ID NO: 8015 - protein, 436 aa, Unknown
  Description of Unknown: Brachybacterium massiliense sequence
MPLVRSEDACSPPRWKAGSVNVEKNRHRPRHLEEQHRPLRVLITTDWWEPVVNGVVASVQTLRRELIALGCDVRVLTLSQGIRPHHEPGVYRIGSVSASLVYERARIGMPSSRRVLKDILGWRPDVVHSQAEFSTYVWARRIARTLSVPLVHTYHTIYEDYTHYYSPSRTMGRKVVESFSRRALSAADAVIVPTAKVARLLDSYGVDRPLHVVPTGLDLNKFRPARSAEELEDARALRESLGIDARQRVLVSVSRLAKEKNLDEVLEMVAAADRPDTVLVLVGDGPHRPELEARAEALGIAHRVRFTGVVEPAEVQRWYRVGDVFVSASRSETQGLTFIEAMASGLPLLARRDPSLENVILEGRTGWQYEGSAQFAAQLDRLLGEPMRREQMAVAALEHAHATFGAQEFGRQALSVYQQARARRSPQIIRHELVAA

SEQ ID NO: 8016 - protein, 394 aa, Unknown
  Description of Unknown: Corynebacterium-like bacterium B27 sequence
MGADTFSPDVNGSARFAEHLASGLASRGHDVHVVAPSAKLPVGAHVEEYDGQKVTVHRLYSWRWYPHDWLTFALPWRIKQNSARIIDEIKPDVVHFQSHIIVGRGVSTEAEKRGIRIIGTNHVMPENMMAFTVIIPKFLQNWAIGLAWAAARRSFIRADAVTAPTRRAADFFEKATGIGNVYAISCGINVDNYVPDFTPRRENRVLFVGRVAGEKQIDVLLKAVQLLPADLDTKVEIVGGGDQLRNLQTMAQQLGLGDRVTFTGYVSEDELRKAYTRATVFAMPSIAELQSIATMEAMASGLPVVAADAMALPHLVHDGKNGFLFEPGNAQQLADRLEHILRLPQEELDVLKRESLSIVAAHDIQRTLTTFEHLYRGEPVTDPVVAPPAAEEHA

SEQ ID NO: 8017 - protein, 403 aa, Haloechinothrix alba
MNVTLPQQVAIRRQRRILIGADTFQPDVNGAARFAERLATGLAGRGHDVHVICPSTDTRSRTELFHGVIVHRLGSRRTPFHPSFRVCPPWRAGRDLDRIMSEVNPDVVHAQSHFVIGRALVNGATARGIPAVATNHFMPENLLGYLPLPHALGARAARWAWRDLGRVYGRVDAVTAPTPRAVALLRSHGFVHEARAVSCGIDAERYQNNGNTIAGTILFVGRLDKEKRVCELLRAVGLLADPDIRVEIVGDGACRAQLTELAEQLGIAGSVRFHGFIPEQDLLAAYARAEVFCMPGVAELQSIATLEAMSAGKPVVAADAVALPHLVREGVNGWLYRPGDVHGLADRLRRVLRAPGGSARLGAASRLLAGEHALATTLDQFEDVYSEVVTVPNESIASASTPE

SEQ ID NO: 8018 - protein, 430 aa, Unknown
  Description of Unknown: unclassified Cryobacterium sequence
MTNSGSLTLGQCLLSDLTDLPSESSPREPAKKPLRILIAADTFAPDVNGAARFAERLAAGMVARGHEVHIMAPAASRKFGTWTEVHEGQPMVVHRLQSWRWYPHDWLRYALPWFIPRETRKILDTVKPDVVHFQSHINVGRAVTIEAAKRGIRIIGTNHFMPENMLEFTLVPKGLHDRLIKAAWRAARRTYGRAEAVTTPTLRAAQFLERYTGLEGVLAISCGIDAHNYSPTFAPRTENRILFVGRVTGEKQIDVLLRAVVLLSPDLDVKVEIVGGGDQKRNLEHLSQTLGLSGRVTFTGYVTDAELATAYTRATVFAMPSIAELQSIATMEAMASGLPIVAANAMALPHLVHDGQNGYLFEPGNAQDLADKLTTVLMAAPDDLNALKNSSLRLIGVHDINRTLNTFECLYRGEPVIDAVTSDAAARGAE

SEQ ID NO: 8019 - protein, 423 aa, Nocardiopsis potens
MAAKSTTAPRERTDSGRGPGKEPRLRVLIGSDTYPPDVNGAAYFTERLARGLAARGHDVHVVCASTAGRPGVHRAGGVVEHRLRSMPSLVHESVRLALPPGAPGHLDRLLARLRPDAVHVQNHFLVGRLLLGAARRCGVPAVATNHFMPENLFNYLYVPGPLRSGIGRLAWRDFRRALAGVQHVTTPTRIAAQLLLDQGFDRPVEAVSCGIDLERFHPPGGGPGERARIRARLGVPDRPTFAFVGRLDEEKRIEDLIRAVRRVPVDGAQLVLAGTGAQRARLERLAEEEGVSDRVRFLGFVPEEDLPLVYRAADAFAISGIAELQSIATLEAMASGLPVVAADAMALPHLVHVGRNGYLYEPGSADDLAKYLGAILASAGERARMGAESREMAARHDHERSLDRFERIYRDVASRSAVLGSAP

SEQ ID NO: 8020 - protein, 395 aa, Microlunatus soli
MKIVIGADSYAPDINGAARFAGRLARGLAARGHEVHVVSASTEGPEQLEHDGAVTIHRMRSIRYRWHATMRVCLPWLAGPDARDLLEQLQPDVVHVQSHMVVGRAVANAADRLGIPLVATNHFVPENVFGYVPFLPRRFHGPAGRMAWRDLARVFGQADVITAPTPLAVSLLTEATGLSGEAVSNGIDVQRYQEAARQAELNADPQAGPVILFVGRLDQEKRVDELIAAFARIPAETGARLEIVGGGDQFDALVGFAAELGVDDRVSFLGQVSDEELLAAYGRASIFCMPGVAELQSLVTLEAMSAGKPVVAANAMALPHLVQSGHNGWLYTPGDIGELALRLSTLVADPRLRERMGQHSRTMVSHHDFEATLDTFTEIYASAGAAVRGQLRSVA

SEQ ID NO: 8021 - protein, 408 aa, Nocardiopsis salina
  MOD_RES (34)..(34): Any amino acid
MARARPLRVLIVTDTYPPDVNGAAYFTRRLPPGXLAGRGHRVHVLRPSAQGPPHVVEAVGVTEHRVRSARIPFQPSMRAALPLGLGGHVDRLLARYAPDVVHVQSHFTLSRTALARARAAGIPTVLTNHFMPDNLYAHARVPRSLQSAAGTVAWNDMVRIAEQADHVTTPTPRAALLLREQGLTRDVEAVSCGIDRTRFRPRTSERSTARRGLGVPDRDSVVFVGRLDEEKRIDELVRALALLIVDLDTQLVLAGTGQREEELADLARVLGVGDRVHFLGLVPDEMLPLVYAAGDVFAIAGVAELQSIATLEAMSTGLPVVAADAMALPHLVAEGRNGYLFPPGEVGVLADRLRRILGSRSERGFLGAASREMAGEHDHHRSLERFETVYARVVGSVPIRRGRRPVTV

SEQ ID NO: 8022 - protein, 391 aa, Pseudonocardia sp.
MKPLRILIGAETYPPDVNGAARFAERLATGLAGRGHEIHVVAPSPTGPAVREVHDGVVVHGVRSHRYYQHEGFQVCMPWETFPAVTALMNDIDPDVVHTNAHMVVGRGVVRAAHRSGRPLVATNHLMPENLIGYSPIPKPLQRVFNTWAWRDLGRVFGKAAVVTAPTPRAVELLVRRAGLVDAFPVSCGIDADRYRSVPHRPGPEPTVLFVGRLDQEKRVDELIRAFAALPDGMPGRLEIVGDGARREEWTALADTLGVAHRVRLRGFVSEQELLEAYAGADLFCMPGIAELQSLVTLEAMAAGLPVVAADAMALPHLVRPGRNGWLYTPGDVPELTTRLAALLGDAATRRRMGAASRDIVSAHAIGATLDRFEGIYDQVLGREQLTARAA

SEQ ID NO: 8023 - protein, 463 aa, Unknown
  Description of Unknown: Candidatus Aquiluna sp. UB- MaderosW2red sequence
MACDTFAPDINGAARFAERLAGGLVRNGHEVHIIAASQDSFSGMRIEQHDGVDLFVHRMRSHRVPQHASARFTAFWGLKRNIRRILNEVQPTAVHIQSHLLMGRFTLWALAGSGTRVIATNHVMPENLIKYSFLPKFLHNWARRVVWKDAGKILRKVDVVTTPTRRAAELLENSSGLSGVLAISCGINAARFANSTPTSNKNPMFLFLGRLDDEKRIPTMLRAVASLTEYPNIKVELVGDGSERGRLQVLARELGIEGRVKFLGHISDDDLPSTYERCTAFVMPSIAELQSIATMEAMASGRPVIGADAMALPHLVHDGDNGYLFPPDDVPALAERMKRILQADDQELLRLSENSLHLIRAHDIVRTVSIFEDLYRGIGEDAPTTADNEGSYSEPIGRLSESIRERLHEFRSDAERLRKRAGDLSHDAKERFGEVREEVREQLSEIRTEVERAAKKLRRKKDD

SEQ ID NO: 8024 - protein, 407 aa, Gulosibacter molinativorax
MKRANVVLPDLLESSRRMCVLIGVDTFPPDINGAARFARDHAVRLARRGHEVHVVAPATSMRSTSGVEIIDGQAIHVHRLRSVRWPLHDWLRFAPPWEVRYQVRRILRETHPAVVHLQSFIDIGRGLAIEAEQAGIPIVATNHVMPENVVEFSGLPKRLHPRLTRFGWNLATTAYTRADIVTIPTPIAADYLERHTGLSPIHPISCGIDTTRFTPKTAKPADARVLFVGRLDPEKNLTTLLTAFSLIPPGTGAHLDIVGRGSESGALRAQAAQLGISGRVTFHGRVTDEQLVSIHHAATVFVMPSPAELQSIATLEALASGTPVVAADAMALPHLVSNGVEGYRVPTHNAHDFADRIERILATDDDGYLRLSTAALARARKHDAATIITHYEKLYDTLTPSIASGAP

SEQ ID NO: 8025 - protein, 405 aa, Unknown
  Description of Unknown: Cryobacterium sp. N22 sequence
MAADTFAPDVNGAARFAERLAAGLVGRGHVVQIMAPAPTRKHGTWTEVHEGESMTVHRLHSWRWRPHDWLRFALPWIVRKQSRAILDSFQPDVVHFQSHIVVGRGVSIEAQKRGIRIIGTNHFMPENMLQFSLVPKGFQDQLVRALWKDAEHTFKRAEAVTTPTRRAAEFLEKYTGLAGVQAISCGIDADNYSPSFAPRTENRILFVGRVTGEKQIDVLVQAVALLDASLNAQVEIVGGGDQRRNLEHLVESLGLSAQFTFTGYVTDEELREAYSRATVFAMPSIAELQSIATMEAMASGLPIVAANAMALPHLVHDGQNGYLFEPGSAQDLADKLTRVFTRSPEELDALKHESLKLIEAHDIKRTLNTFERLYRGESTVDAHAAAQPDPSAARPPVLDVTPRRD

SEQ ID NO: 8026 - protein, 393 aa, Pseudoclavibacter sp.
MAGDTFTPNVNGAAKFTEHLASGMAARGHDVHVMVPAASRRHGTWTEQYDGQNITAHRLRSHRWWAHDWLRYAPPWRIRSESQRVVDEVRPDVVHFQSAVIIGRGVAIEAEKRGIRIIGTNHLMIENLVDHSLLPQALRGLAARIWWNDARSTLGRATAITTPTRRAADFLEANGGISDVLAISCGIRTSDYAFDFSSREAKRILFVGRVTGEKKIDVLLRAMTLLPRDVQLDIVGGGDQKKNLQSLAKQLGLADRVTFHGYLSDQELRRMYTRASVFAMPSIAELQSIATMEAMASGQPVVAADAMALPHLVHDGENGFLFEPNNERDLADKLAKALSLSDAEREEMGRTGLDLVRMHDIDRTLELFERLYRGASVKDVARDSVNEQDHSLD

SEQ ID NO: 8027 - protein, 397 aa, Pseudoclavibacter alba
MAGDTFAPDVNGAATFTEHLASGMAARGHEVHVLCPAASRRHGTWLERYDGQTITAHRIRSFRWYPHDWLRFAWPFTARRNARRVLDAVKPDVVHFQSAVVLGRAVTIEAAARGIRIVGTNHLMPENIMEHSLMPKVLHEPIAKTWWRDAAKTFARAHAVTTPTRRAARFLEQQGKVEHVLAISCGLRVSDYTADLSDKSPKRILFVGRVTGEKQIDVLLKAFAKLHAEMPDVELGIVGGGDQKHNLEKLSEQLGVADRTIFHGYVSDQELRSLYTHATVFAMPSIAELQSIASMEAMASGLPLVAANAMALPHLCHDGENGFLFEPGNVDELAERLRQVLTMSEDERAKLANKSLEMVQVHSMDRTLELFERLYRGESIESVARDSFNEQDRTLDH

SEQ ID NO: 8028 - protein, 418 aa, Subtercola sp.
MGADTFSPNVNGSARFSQRLASGLAARGHEVHVVAPAASRRHGTWTESYDGQNITVHRLRSFRWYPHDWLRFSEPWFINRNSERIIDQVKPDVVHFQSHIIVGRGLSIAARKRGGIRVLGTNHFMPENLLEFTLLPKSWQEKAISMAWKAAKRTFGRADVVTTPTQKAAEFLEKSTGLDGVLAISCGIDADNYVPDFAPRTENRILFVGRVTGEKQIDVLIKAVSLLPDDLDAHLDIVGGGDLLKHLENLTKQLGVDDRVHFTGYVTEDELREAYTKATVFGMPSIAELQSIATMEAMASGLPVVAANAMALPHLVKDGRNGFLFAPGDAQQMADKLEHILRLPQDELDAFKNASLAFIAKHDLVRTIVTFERLYRGASDVDVAAIDATMAAESLNTSSLRVIDLPAEPTAEPSDAAR

SEQ ID NO: 8029 - protein, 393 aa, Leifsonia xyli
MGCDTFAPDVNGAARFAERLAAGLVERGHDVHIVAPAASRRHGTWVEEHLGRKLTAHRLRSWRWYPHDWLRFALPWTSKANARRVLDEVKPDVVHLQSHIVIGRGLAYEAQKRGIRIVATNHVMPENIIEFTRLPRFLHHTFVSLAWKDARKSFDRAEAITTPTRRAAEFLEKATGLRGIHAISCGIDAHNYTPDFGSRTANRILFVGRVTGEKQIDVLLKAVKLLPDALDAKVEIVGGGDQFKNLQALAETLGIADRVAFLGYVTDEELRAAYTRATVFAMPSIAELQSIATMEAMASGLPVVAADAMALPHLVHDGENGFLFRPGDAQDLADKLKSVLTLPQDELDALKNASLRIVASHDIQTTIATFESLYRREQVADPVTEAAVEPATE

SEQ ID NO: 8030 - protein, 423 aa, Nostoc punctiforme
MFQNKKHRIALISIDGDPAVEIGQEEAGGQNVYVRQVGYALAQQGWQVDMFTRRSNSEQSAIAQHGPNCRTIRLKAGPAEFIGRDNLFDHLPEFIEEFQKFQQRQGFHYSLIHTNYWLSSWVGMELKKQQSLIQVHTYHSLGAVKYRSIGDVPVIAAQRLAVEKACLETIDCVVATSPQEQKHMRVLVSSKGNIEMIPCGTDTDKFGGIQRTAAREKLGIAPDAKIVLYVGRFDRRKGIETLVRAVAKSSLRGEANLQLVIGGGSRPGQSDAIERDRIASIVTELGLENCTTFAGRLDETVLPFYYAAADVCVVPSHYEPFGLVAIEAMASQTPVVASDVGGLQFTVVPEVTGLLAPPKDEVAFAAAIDRILINPTWRDQLGEAARQRTEIAFSWYSVGFRLTQLYTRLLAQTASNTRPRIAA

SEQ ID NO: 8031 - protein, 1053 aa, Solanum tuberosum
MAGNDWINSYLEAILDVGPGLDDKKSSLLLRERGRFSPTRYFVEEVITGFDETDLHRSWIRAQATRSPQRRNTRLENMCWRIWNLARQKKQLEGEQAQWMAKRRQERERGRREAVADMSEDLSEGEKGDIVADMSSHGESTRGRLPRISSVETMEAWVSQQRGKKLYIVLISLHGLIRGENMELGRDSDTGGQVKYVVELARALGSMPGVYRVDLLTRQVSSPEVDWSYGEPTELAPISTDGLMTEMGESSGAYIIRIPFGPREKYIPKEQLWPYIPEFVDGALNHIIQMSKVLGEQIGSGYPVWPVAIHGHYADAGDSAALLSGALNVPMLFTGHSLGRDKLEQLLAQGRKSKDEINSTYKIMRRIEAEELTLDASEIVITSTRQEIDEQWRLYDGFDPILERKLRARIKRNVSCYGRFMPRMAVIPPGMEFHHIVPHEGDMDGETEGSEDGKTPDPPIWAEIMRFFSNPRKPMILALARPDPKKNLTTLVKAFGECRPLRDLANLTLIMGNRDNIDEMSSTNSALLLSILKMIDKYDLYGQVAYPKHHKQSDVPDIYRLAAKTKGVFINPAFIEPFGLTLIEAAAYGLPMVATKNGGPVDIHRVLDNGLLVDPHDQQAIADALLKLVADKQLWAKCRANGLKNIHLFSWPEHCKTYLSRIASCKPRQPRWLRSIDDDDENSETDSPSDSLRDIHDISLNLRFSLDGEKNDNKENADNTLDPEVRRSKLENAVLSLSKGALKSTSKSWSSDKADQNPGAGKFPAIRRRRHIFVIAVDCDASSGLSGSVKKIFEAVEKERAEGSIGFILATSFNISEVQSFLLSEGMNPTDFDAYICNSGGDLYYSSFHSEQNPFVVDLYYHSHIEYRWGGEGLRKTLVRWAASIIDKNGENGDHIVVEDEDNSADYCYTFKVCKPGTVPPSKELRKVMRIQALRCHAVYCQNGSRINVIPVLASRSQALRYLYLRWGMDLSKLVVFVGESGDTDYEGLIGGLRKAVIMKGLCTNASSLIHGNRNYPLSDVLPFDSPNVIQADEECSSTEIRCLLEKLAVLKG

SEQ ID NO: 8032 - protein, 442 aa, Halomonas daqiaonensis
MNVLMFTNTYLPIVGGVSESVQRLKRQLLAAGHRVLVVAPRLEGQPREEHDVMRVMAVQHFNGSDFSLPVPIPGQLQEAIESFDPDIVHAHHPFLLGDTAARAAETYGLPLVFTHHTLYEQYTHYVPGDSPRMQRFAMALATQYTWLCDEVIAPSESIRDLLLGREANPRISVVPSGVDTVRFASGDGDNWRDRLGIPEAALVIGHLGRLALEKNLAFLAEAVAEALVRELGAHFLVVGEGEARSDIQALAEARGVAGRLHFTGRLQDQALIDAYHAMDVFAFASHSETQGMVVAEAMAAGLPVVAIDAPGVREVVVDGRNGRLLAEDDVDAMAEALVALADYDVRLPLAEAALETAADYDEARCSERCLAVYRRAIARGGPFTHADEGGWERVRYRLGAEWQMLCYRGRLLRHLVQEEWEQERPAWWPGHHAEDESEVPRK

SEQ ID NO: 8033 - protein, 384 aa, Kocuria rhizophila
MRILITAETYPPDVNGSAQFARRLAHGLLDRGHEVHVAAPMPTSGPSRTMTDDGVVEHRFRSHHAFTHPYFRLCFPWEIAREVSRLLDELRPDVVHVQCHYILGRLMVREASRRGIRVVGTNHFIPENIEPFLPFPQWFIRGYRKVSWWDIARVYGRCDVITAPTPLALRTMVDNGVPDRAVAVSNGIDAGHYEAAPDELIEHPEHPVVLFCGRLAVEKNVNELIEALALIPREKNVHVELAGEGEQRDRLLRLAHERGVADRVEFLGFLTDEDLRRAYLRADVFCQPGTAELQSLVTLEAMSASTPVVLANARALPHLADEGRNGYLFTPGDPADLAAKLQLVLDADPERRRAMGERSHEMVAQHSFARTLDTFQRIYAGASR

SEQ ID NO: 8034 - protein, 405 aa, Actinoplanes derwentensis
MRVLIGADTYAPHVNGASYFAQRLAVALTARHEVHVAAPSLGLRSHTVRTATGVTEHRVRSLPIPGHPGYRFCPPWTPSATAGRAGWGLRAEAARILDEVRPDVVHVQSHFPLCRALIEAARERGLFVIATNHFMPENLLHYLPIGTAGRANLHGWAWRDAARVFTGADIVTAPTPYAAALATLSGIPGPVLPISCGIDLARFRTEAPTADFRRAHGLAANPVITYVGRLDAEKHIDVLIQSFALIQRSTGAKLLLVGTGAEHRALTTLAGDLGVAEHVVFTGFLPDEELPSAYAATTVFVNAGTAELQSLVTLEAMASGRPVIGADAAALPHLVLDGETGYLFPPGDPAALADCLTRLLSDPVHAAALGRRAREVAEQHDATHTTAAFEHLYAIPQPTPAEVAA

SEQ ID NO: 8035 - protein, 397 aa, Unknown
  Description of Unknown: Microbacterium sequence
MAADTFAPDVNGAARFAERLAAGLVERGHDVHVVAPASSRRHGTWTETHEGQRMTVHRLYSWRWFPHDWLRFALPWRSRKNAARILDAVKPDVVHSQSFLVVGRGMTIEAARRGIRVVATNHLMPENLLEFTLLPRFVQEPAVKTMWRDARKILSLASAVTTPTRRAADFLERSAGRNDVHAISCGIDASLYHPVFEKRTENRIIFVGRITGEKQIDVLIKAFSRLDESLDAKLEIIGGGDQKRNLEALAQQLGVADRVTFTGYVTDEQLKTAYSRATVLAMPSIAELQSIVTMEAMATALPVVAANAMALPHLVHDGENGYLFTPGDEHELAARLTDVLTLDEKQLEAMKRASLRMIRPHDIQNTLTTFESLYRGEAVIDPVTDVSDVSDDERRGR

SEQ ID NO: 8036 - protein, 384 aa, Kocuria rhizophila
MKILITAETYPPDVNGAAQFGRRLAHGLLERGHEVHVAAPMPTRGASRTMEDHGITEHRFRSHHAATHPYFRLCLPWEIKREVARLLDELQPDVVHAQCHYILGRLMIREAARRGIRVVGTNHFIPENIEPFLPFPEWFIRGYRKVSWWDIARVFRHCDVITAPTPLAVRTMVENGVPDRAVAVSNGIEAGHYEAAADEEIRHPDHPVVLFCGRLAVEKNVNELIEALALIPREKNIHAEIVGEGEQRDRLVALAHERGVADRVHFLGFLTDEELRLAYLRADVFCQPGTAELQSLVTLEAMSASTPVVLANARALPHLADEGRNGYLFTPGDPADLAAKLQLVLDATPEQRRAMGTHSHEMVAQHSFAHTLDTFERIYAGASR

SEQ ID NO: 8037 - protein, 366 aa, Unknown
  Description of Unknown: Halobacteriales archaeon QS_3_64_16 sequence
MASVPHVAAFTDTYLPTVNGVTYTIRTWRERWDERGGRMDVVYPSSAEYAGEGGEFSVPSLPFPFYEDFRVGAPAIPDAVRDCEIVHAHTPFGVGLGGLKLARAEGRPLVASYHTPTSEYAGYLVEGWLREVVARVGDAYERWFLDRADRIVAPSETARKALRERGIGPVSVVPNGVDIDRFAPVEFEGFRARYDLPEGPLVGYTGRHGYEKRLSDLLAAAADVDATFVFGGDGPARESLEAQAAELGVDTRFLGFLDREELPEFYSALDVFAFPSPIETQGLVALEAMACGTPVVGVASGALVDTIAEGETGYHYPPGDVEAFEGALRRALADRDRLREVCLSRREAVSVEHAIDELESVYDDVR

SEQ ID NO: 8038 - protein, 419 aa, Agreia sp.
MSDSSGPRPASAEVPSTASSERPLRIVIGADTFSPDVNGSARFSERLASGMASRGHDVHVVAPAASKKHGTWTETYDGHDITVHRLRSWRWYPHDWLRYALPWVINQNSAKILDAVKPDVVHFQSHIVVGRGLSIEAEKRGIRIVGTNHFMPENLLEFTLLPKSWQDWAVGLAWKAAKRTFGRASAITTPTRRAAEFLEKSTGLTNVYAISCGINADNYTPDFTVRPKNRILFVGRVTGEKQIDVLLKAMTLLPDDLDAQLEIVGGGDLKKSLEAMAVTLGIADRVTFTGYVTEQELRDAYTRATVFAMPSIAELQSIATMEAMASGLPVVAADAMALPHLVHDGENGHLFAPGDAQQMADRLADILTLPQDELDVFKNASLRLIAAHDIQRTLTTFEKLYRGEVVTDPLIVSPSASHE

SEQ ID NO: 8039 - protein, 415 aa, Unknown
  Description of Unknown: Brachybacterium muris sequence
MLRPRPLERNVPRPERPLRVLLTTDWWEPVVNGVVASVSTLRRELEALGCEVRVLTLSGGMRTWSEDGVYHIGSLSAQLVYDHARIGMPANKHVLAEILQWQPDVVHSQCEFSTHVWARRIARTLGVSLVHTYHTIYEDYTHYYSPSRTVGRKVVATFSRRLLEGTDAVIVPTEKVSRLLRSYKVRRPIHVVPTGLDLQRFRPATTAEERADAAALRASIGVRPDQRVLISVCRLAKEKNLDEVLENLAAAGREDVVLVLVGDGPYREELVHRAVELGIAERVRFTGVVDPQEVQRWYRIGDVFVSASLSETQGLTFIEALACGLPLLCRRDPSLAPVVIDGVTGWQVEGTEEFRLRLDQLLDDDISREAMSGAAVEHARDTCGAREFGQAVLEVYRQTRTRRTPRILSRQVVPA

SEQ ID NO: 8040 - protein, 374 aa, Promicromonospora kroppenstedtii
MNGAARFAGSLATGLAGRGYDVHVVAPSPTGKPVREVRDGVVLHGLRSSRYPTHHNLQISLPWETRRAVTEILDEVRPDVVHTNGSFIVGRALVDTAHRAGLPIVATNHLMPENLVGYLLVPGSMHRTVGRWLWQDIGRVYAKADVVTAPTPRAVDLLAQHAGLSHAIPVSNGIDTDRYTTTVREGRAEPTVLFVGRLDQEKRVDEIIRAFALLPEDLPGRLEIVGTGAKADEWAALAAESGVAGRVRFRGYVPDDELLAAYSAADVFCMPGVAELQSLVTLEAMASGLPVVAADAMALPHLVRPGVNGWLYTPGDVRELANRLGDLLADAGLRRRMGAASRELVAAHAVDGTLDAFAEIYEKVHATRATAAAA

SEQ ID NO: 8041 - protein, 419 aa, Halomonas heilongjiangensis
MKVLMFTNTYLPIVGGVSESVQRLKRRLQDAGHRVLVVAPRLAGQPAEEPDVVRVAAVQHFNGSDFSLPIPLPGQLFDEIETFEPDIVHAHHPFLLGGTAARVAETYGLPLVFTHHTLYEHYTHYVPGDSPRMRRFAIALATEYTRLCDAVIAPSESIRDLLLERGANPEISVVPSGVDTLRFVMGNGSGRRERLGIAPEAYVVGHLGRLAREKNLAFLAEAVACALAVLPEAHFLVVGEGEARRTMAEIATVRGVAARFHFTGRLEGQALIDAYHAMDVFAFSSHSETQGMVLAEAMAAGLPVVAVAAPGVCEVVVDGHNGRLLAEDDAAAMAAALIDLAGVERRAPLGEAALATAAAFDEACYAERCLVVYRRAMACRPPFAQVDDRGWERVRSRLGAEWQLLRHRGRLLKHLVQEE

SEQ ID NO: 8042 - protein, 388 aa, Unknown
  Description of Unknown: Frigoribacterium sp. PhB107 sequence
MAADTFPPDVNGAANFAERLAVGMAARGHDVHVLAPAASRKHGTFLEQHAGVTLTVHRLYSTRWPLHDWLRFATPWRAEANAERVIRQIQPDVVHIQSHIVIGRAVVRVANRLGIRAVATNHFMPENLLEHTGLPHALRATAVKMAWADASRTYHRVESMTTPTDKAARFLEKAIDVEGVLAVSCGIEASNYTARDDRPEGNRIVFVGRVTAEKQIDVLLRAMTLIDPTLESTLTIVGGGDLMRHLQQLSVDLGLAGRVTFAGYLSDAELRRTLTDATVFAMPSIAELQSIASLEAMASGLPIVVADAMALPHLVDDGGNGWLFRPGDSADLADKLTRVLTSPDDEYLTMRRASLRMIEGHDIERTLNVFEGLYRGQPVAPTTDVVSY

SEQ ID NO: 8043 - protein, 362 aa, Unknown
  Description of Unknown: Candidatus Altiarchaeales archaeon sequence
MNIGIFTDTYFPQVNGVVYTIFEWKKRLQKFHDIYIYYPDSEYEPKKNEFPFRSYEFKFYKGYNIAFPTDISEKAKNLDMVHIHGLFTMAMAGLYVSRKFRLPKILTYHTPADDYINYITRKEPFRTTLMKLYNFWEKRLLNSCDIITAPSKTIKNRLIEKGVDKDIIILSNGVDLDFFHYTNPERFKEKYGINAERVIGFCGRFGYEKHLEDIIGIADDFDGDIIMAGKGPAQDYYMNMAREKKNVRFLGFLSREELREFYSSIDLFIFPSTAETQGLVALESMACGVPVIGANALALKDTIEDGKTGYLYEQGNIRELKKMIDKAYKNREVLSRNCLKSVKRHSMDNTIKRLLEIYESLV

SEQ ID NO: 8044 - protein, 382 aa, Unknown
  Description of Unknown: Microbacterium sp. sequence
MGCDTFAPDVNGAARFSERLAAGLVARGHDVHVVAPNRVYRRASPAVEQIEGEPVIMHRLPSVRWPPHDWLRFVWPWRSKHYARRVLDEVRPDVVHIQSHIVIGRGLAREAHKRGIPIVATNHVMPENILDFTTLPPVLDRLFVKLAWDDAARTFALTRAVTTPTRKAADFLEAAIDIDGVVPISCGIDAAKYTADLSPRDRHRVLFVGRLTREKQIDQLLRAVAALDPALDVDVEIVGGGDQRKHLEQLAEQLGIADRVVFHGRVDDDELRRIYTRASVFAMPSVAELQSIATMEAMASGLPVVAADAMALPHLVREGDNGYLFDPASIDELTAALTRVLTADPDERRRLQQASLDGVKIHDIDRTLRTFEALYRGEPVEG

SEQ ID NO: 8045 - protein, 372 aa, Halegenticoccus soli
MDAVVAFTDTYLPTVNGVTYTVQTWRDRWRARGGRMDVVYPAADGYEPAEGEYPIRSLPFPFYEGFRFGLPKVPESVRDADIVHAHTPFALGLGAMRLARRERRPLVASYHTPTGEYASYLTSRERLEDRIEGLSERYERWFFDRADAVIAPSGTARRSLLDAVGVETDVTVVPNGVDVERFRPVDAAAFRERHDLGGGPLVGYTGRHGFEKRLSDAVDAVAGADIDATLVFGGDGPARPHLAARAENRGVDARFLGFLEREELPAFYSALDAFLFPSPVETQGLVALEANACGTPVVGVNRGALADTIVEGVTGYHFEPGDVEGFAAAIERTLDERERLRDGCLDRRDGVSVEHAVDRLAEVYASVRKTKP

SEQ ID NO: 8046 - protein, 379 aa, Unknown
  Description of Unknown: Microbacterium sorbitolivorans sequence
MGCDTFAPNINGAARFAERLSAGLVQRGHAVHVSAPNVRYALEKPRIEKIEGEDLVLHRLPSVLWIGHEWLRFIWPWRSKHYARKVLDEVRPDVVHIQSHIVIGRGLTREARKRGIPVIATNHTMAENILDSTRLPEWGNKLFVKLAWDDARRTFNMVSALTTPTRKAADFLETTLGISGVIPISCGIDMHQYTAVIGPRDAKRIVFVGRLTAEKRVEDLVRATARIPDATLDLVGDGDQRDALAKLADELGIRDRVVFHGRVSDEELRAALTRASVFAIASIAELQSIATMEAMASGLPIVAADAVALPHLVSEGENGYLFEPENIDELVEKLDRVLGADDAAYEAMQRASLEMVSAHDITRTLDTFEALYRGEQIPA

SEQ ID NO: 8047 - protein, 419 aa, Rathayibacter toxicus
MSDSRDESRQVSADVGLAALTVLIGCDTFAPNVNGAAKFAQRLAAGLAERGHEVHVVAPSADGWNGTRYETHEGQRIVVHRLYSWRWFPHDWLRFAMPWRIRQNSARILDKVKPDVVHFQSHIIVGRGLGIEAAKRGIRIIGTNHFMPENMLEFTLLPKAVQAKAVQMAWRAARRTFDRAEAVTTPTRKAAQFLETYTGLRGVHAISCGIDASNYTPDFSPRTSNSILFVGRVTGEKHIDVLLRAVALLDPSLEATLDVVGGGDQLRQLQQLGAQLGIDDRIRFTGYVSDAELREAYTRATVFAMPSIAELQSIATMEAMASGLPVVAADAMALPHLVQNGKNGFLFEPNNAQALADRLTDVLNADEEAFSAMKRASLSIVAAHDINRTISTFESLYCGEPVADLAADAASDPARRSAS

SEQ ID NO: 8048 - protein, 426 aa, Microbispora sp.
MNALPLTSVPAAPEALPGAPVEEPPALAVAGARVPRLRVLIAGDTYPPDVNGAAHFTHRLATGLAARGGQVQVVCASPEGPARTETGDGVVVHRMRSAPLLVHPTMRVSLPAGLGRALAGLIARVRPQVVHVQGHFVVGRAAVRAARAAGLPVVATNHFMPDNLFQFGRVPARLRGRAGDLAWRDLTRVFARADHVTTPTRIAAGLLRDKGLAGDVEAVSCGIDLERFRPQPRPWAREWALRRFGLPDRPTVLFVGRLDEEKRLEDLVLALPHVLNHVDVQAVIAGTGGRRAGLERLAARVGVGDRVRFLGFVPDDELPRVYAAADVFAMPGVAELQSIATLEAMASGLPVVAADAMALPHLVAGNGRLYRPGDVQAMARHLTAVLTSDRLRAEMSTVSLAMAAEHDHRHSLARFEEIYRELAAEQ

SEQ ID NO: 8049 - protein, 436 aa, Unknown
  Description of Unknown: Nocardiopsis sequence
MKERTPGNAGQGSRPSGGPERLRVLIAADTYPPDVNGAAYFTYRLATGLAGRGHDVHVVCASATGRPGIEYEDGVVLHRLRSASVVVHPTMRTAVPLGVGGHVARIVERLAPHVVHAQSHFTVSRAAVRRARLSGAPVVLTNHFMPDNLFAHAHVPAALQGAAGALAWRDMVRVAYDADHVTTPTRRAADLLAAKGFSRPVEPVSCGIDLERFRPRPAERAEVRKRFGLEDRDTMVFVGRLDEEKRIDDLIRALAALKDRRDLQLALAGTGQRQAELARLADELGVADRVRFLGFVSDEELPLVYVAGDVFAIGSVAELQSIATLEAMATGLPVVAADALALPHLVDQGGNGFLYPPGDSDALAERLGEVLASDRRQAMGEASRALALTHDHERSLDRFEEIYRSVRPRRPGAPVADRALRAVAGTGERRRSPAAA

SEQ ID NO: 8050 - protein, 403 aa, Unknown
  Description of Unknown: Cryobacterium sp. GCJ02 sequence
MAADTFAPDVNGAARFAERLAAGLVSRGHVVAIMAPAATRKHGTWTEVHEGESMTVHRLHSWRWYPHDWLRFALPWIVRRHSRAILDSFQPDVVHFQSHIVVGRGVAIEAQKRGIRIVGTNHFMPENMLQFSLVPKGFQHQVVKALWKAAEHTFRRAEAVTTPTRRAAEFLEKYTGLTGVHAISCGIDADNYSPSFAPRTENRILFVGRVTGEKQIDVLVQAVALLDASLDAQVEIVGGGDQRRNLELLVESLGLSSRFTFTGYVTDEELRQAYSRATVFAMPSIAELQSIATMEAMASGLPVVAANAMALPHLVHDGQNGYLFEPGSARDLADKLTVVLTAAPDELDALKNESLKLIEAHDIKRTLTTFEHLYRGEPIDSPATATTESASSRQVLDGTPAHD

SEQ ID NO: 8051 - protein, 366 aa, Halococcus sp.
MPPHVAAFTDTYLPTVNGVTYTIRVWRDRWRARGGRMDVVYPAADGYDPDPDEHPVRSLPFPFYEDFRVGAPSVPDGVETADVVHAHTPFGVGLGGLRLVRRIDAPLVASYHTPAAEYAGYLAEGWLMDAVARAGNAYERWFLGHADHVVVPSEVARAELESRGIGPLSVVSNGVDIERFAPTTTDFRARHDLPEDRPLIGYTGRHGFEKNLSDLLAAAAGTDATVVLGGDGPARKTLETEAAELDADIRFLGFLEREELPEFYNALDVFGFPSPVETQGLVALEAMACGTPVVGVDAGALTETIDEGETGYHYRPGDIAGFRDTLGRALADRDRLAETCRSRREGMGVDHAVDALTDVYDTVGVE

SEQ ID NO: 8052 - protein, 415 aa, Halomonas sp.
MKILMLSDVYFPRINGVATSIASFRDALERLGHSVTLICPDYPVGQVDEPNVLRVSSRGVANSPEDRMMRYREVMALLPSLAVERFDLVHIHTPFVAHYAGTALAKRLGLPALATYHTLFEEYLPHYVRGVPSGWLRFIARRLSVRQCRRLKALVAPSHAMRETLERYGVKTRVTVIPTGLALERFSQPADEEDFRARYELPDNARLLLFVGRLAFEKNIAFLIDLLPRILAEHPDTRLIITGEGPARVELTRRARQIGMEYAVRFLGYLDRHGQLQAAYRAADVFVFASRTETQGLVLLEALALGTPVVSTAMMGTRDVLIEGEGCLIANEELDDFAAKVSRLLGDETLRSELARRAKHYATGWHEDAKGIELAALYARLCAKQGPQPNAVAELPAASVGAPPPLAPLTSRVED

SEQ ID NO: 8053 - protein, 396 aa, Galactobacter valiniphilus
MSAERPLRILIACDTYPPDLNGAAVFCFRLAKAMSSRGHEVHIVAARTDDGPSFVEHRPEATVHRVKSHKAPTHESYRLCLPVTANKVIAEVIDEIKPDVVHIQCHYMIGNAAEKQATKRGLRLIATNHFIPENLEPFLPFPQWFLNIVSKNSWRDMGKIMGRADVVTTPTPLAAREMRLRAGLEHVLALSNGIDSAKYEAHEGEEIAHPDHQVVLFAGRLAVEKNVDVLIRAMARLKGANPPHLRLVGEGEQRPKLLKLAQDLGVEDRVHFLGFVDDETLRAEYLAADVFCQPGTAELQSLVTLEALSASRPVVLANALALPHLVDEGVNGYLFEPGNDADLASKLETVLDLSPADREAMGAAGHAKALLHAEKKTMDTFEDLYRGAPAAKYMDA

SEQ ID NO: 8054 - protein, 391 aa, Actinoplanes rectilineatus
MRILIGADTYAPHVNGASYFAQRLAGALNREDGADVHVVCPADGVRSTTRVTADGITEHRVRSLPVPGHQGFRFCLPVALRRAAGRILDEVRPDVVHVQSHFPVCRALVDAACERGVPVVATNHFMPENLTHYLPVGDAGRQLVHEWAWRDAARVFAKADVVTAPTPYAAALATLAGVPGPVLPISCGIDLRRFRTATPAGEFRLRHGIPAKPTVTYVGRLDAEKNLDVVLRAFAEVAVDAHLVLVGAGAERHHLEELAEKLNITRNTTFTGFVPDDELPAAYAATTVFVNAGTAELQSLVVLEAMASGRPVVGADAAALPHLVVDDETGYLFPPGDHAALAARLRTVLADEARAQALGKRARQVAEQHDEARTVAAFQQLYALRAGVTVR

SEQ ID NO: 8055 - protein, 392 aa, Thermacetogenium phaeum
MKIGVFTDSYRPYVSGVVRSIETFSRELRRLGHEIYLFAPHYPQTKGEKEVNVFRFPSFHTPFNPEFYIALPFPRRVVRYASGLGLDVIHVHSPFMLGQAGARLARSLDLPLVFTYHTLYDQYLHYAPLAGKLAKRGIIAYARNFCNRCDLVITPTGVIREMLFGYGVQKPVVAIPTGIYPERFRDGDPDFLNKNFGVPPDKRVLLFVGRIGKEKNLAFLMRAFALVSRQVDDAVLVLVGSGPEEAALRRMAYTLGVGDRVVFTGRLPPEVVAGAYAGAYLFAFPSVTETQGLVLVEAMAAGLPVVAQAAFGSLAMVQDGVTGYLCRGGEEEFAAKVLELLDDSDLHRRMAEAAAQWAWKLSAEKMALRLEKAYLALVHGDHDRLLQMGEEW

SEQ ID NO: 8056 - protein, 386 aa, Thiothrix lacustris
MHILMVSDVYFPRVNGVSTSIQAFRQALQAAGHRVTLIAPAYASVTDAETDIIRISSRNVIVDPEDRMMRIRDIHRLTDTLRAGDYDIVHIHTPFVAHYAGLKLARKLKLPVVATYHTFFEEYLYNYIKWLPKEWLRYAARRFSRTQCADLDALVVPSAAMQQVLLHYGITTPLTVLPTGLDMNVFASGDGVAFRQQYGIEPERPMILFVGRVAFEKNIGFLLDMTAQLRERIPDILLVIAGEGPAEKGLQAQVARHGLQQQVRFVGYLPRDGGLQACYKAADVFVFASRTETQGLVLLEAMACGTPVVSTAVLGTSDIMHGEQGGLIAEEEPAAFAAQVERLLDDKALHARKVTEALAYAATWSHTAQAEKLLGFYQQVPTQHNR

SEQ ID NO: 8057 - protein, 391 aa, Tropheryma whipplei
MVHGKSLRVLIGTETFPPEVNGAAKFSGRLASCLIERGHIVRVVAPSRTRGRGGEYLEEIEGNAVLVYRLPSVKWPGHSWFRFASPLFVSRFCSKIIDDFQPDVIHYQSHFMIGLSLSKKGRARGVRLVGTNHFMPDNVIHYCEFLPTFLHKFLWKANWHYASRCFARADVVTSPTQSAANFLERYTTIENVVPISCGIDLSGYTPSFERGSVLLYVGRITREKQLDVLIRAFAKLNNKDITLKLVGIGEEVEPLRALAYSLGVSDRVVFCGYLEEGDLRKTYSEASVFVMPSTAELQSIATMEAMASGLPVVGADSMALPHLVRDGENGYLFSPGDPDDLASKLTAVIALDDADFAAMQRRSLEIVAEHEIDRTIDAFERLYAGSQVSCN

SEQ ID NO: 8058 - protein, 402 aa, Methylotenera versatilis
MKILFISDVYFPRINGVSTSIRTFVLQMQNLGHEVHLIAPDYDVVTEDEAWIKRIPARSIYFDPEDKLMKYGEAVKLLPALEQEKYDIIHVHTPFVAHYLGLKLAAQLNIPCIETYHTFFEDYLHHYLPWMPKSIARGIARMISKRQCNAVDAIVAPSNPMLDVLRRYGVNVLSEVIPTGLQDSSFAAADGQAFRLKYGIPLDRPMLLYVGRVAFEKNIDFLLEMTKILAEKRPDVLLVVTGEGPAEASLHKLAKTLEIEKNVQFIGYLDRNKELNACYESADIFVFASKSETQGLVLLEAMAQATPVVAIAELGTASILIEGKGALIAPDDTAQFAERVRQLLLNPEHRFELGNRAKNYALDKWTATLQAQRMIKFYEEVILSPSSPRQPYLKTQLDPVKG

SEQ ID NO: 8059 - protein, 369 aa, Halolamina sp.
MESVAAFTDTYLPTVNGVTYTVQSWRDRWQARGGRMEVVYPDAPEYEPEPDEHPVRSLPLPIYAGYRLGAPRVPDTVTDVDVVHAHTPFAIGLAGLRLAQKRELPLVASFHTPTSEYAAYLSSWGPVKKPTAALSRRYESWFLNKADAVVVPSESTGEYVATELGVDSPEVVPNGVDTERFRPVDPTAFRERHDLPTDRTLVGYTGRHGHEKSLPAIIAACDRLDREVTVVFGGDGPARAELEEAARKLNVDARFLGFLDREELPAFYAGLDAFLFPSPVETQGLVALEAFACGTPVVGVDSGALSDTVDEGVTGYHFEPDDVDGFADAIARTLDERERLRENCLDRRASISVEHAVDRLTEIYAAVRE

SEQ ID NO: 8060 - protein, 411 aa, Planomonospora sphaerica
MPSSAVSTAEPLPAGSPSAPGSSGTRPCRVLIGTDTYPPDVNGAAYFTHRLARGLARRGNDVHVVCASETGPARTEHVDGVTVHRLRSAPVLVHPTMRISVPARLDRLVAAIAPDVVHVQGHFVVGRAAISAARRAGVPVVATNHFMPDNLFQFAHVPEPLRDRAGDLAWRDFNRVFSRADRITTPTRIAAGLLAGKGFTRPVEPVSCGIDLSRFRPRKEPRAWARKAVDLPDRRTVLFVGRLDEEKRLDELIRALPYVLNGTDAQLALAGTGGRRASLERLARRIGVGDRVTFLGFVPDDMLPDAYAAADVFAMPGVAELQSIATLEAMATGLPVVAADAMALPHLVRPGENGHLYRPGDVHGLARHLTALLESPALCAAMGAASREIALTHDHQASLARFEEIYREVAR

SEQ ID NO: 8061 - protein, 401 aa, Mycobacteroides abscessus
MATQPLTILIGADTYPPDVNGAAQFSHRLARAMKDRGHTVHVMASRQEAGTTTSFDVDGLTEHRVRSHKVVTHSYMRLSFPWEIYKDAEHIVQRIKPDVIHVQCHYIIGRVLARIGKKYGIRVIATNHVMPANINPFLPFPQWGKDLVEKASWSDMRRVLSQAAVVTNPTQIGADAMRASGKFKRLVMPVSNGIQSENYELAPGETVEKDPRELLIFFAGRLAVEKNVDVLIEALALLPESLNHTVLEVAGSGEILESLQVKAHECGVEHRVRFLGYVTDEQLRDGYLRADVFCQPGTAELQSLVTLEAMSASKPVVLANALALPHLVEQGQNGYLFEPGNPQDLAEKLAAVLLLSEENRTKMGQHSHQMIEKHAAEKTWQTFESLYVSNQAYHDFVAGRR

SEQ ID NO: 8062 - protein, 398 aa, Myceligenerans xiligouense
MLRILVGAETFAPDVNGAARFADRLSAGLAARGHEVHVVAPSPLGEPGIERRDGVVVHRLSSHRMPGFDAMRVCLPWEAASEVRDVYERVRPDVVHTNGHLSLGRAVVNHAKRTGVPLVATNHLMPENIVGYLPIPASMHESFAGWMYRDLGRVYAQADTVTAPTPSAVDLISRRAGLTSAFPVSNGIDADAYERARDAVAARRGAPTGPTALYEPTVLFVGRLDQEKRVDELIRAFARLAPDVPGRLDVVGDGERRAAWEALAADLGVAGRVRFRGFLSDDELLTAYATADLFCMPGVAELQSLVTMEAMAARLPVIAADAMALPHLVRPGSNGELFQPGDIDELARHLRTLLTDAALRERYGAASRELIQAHTMGATLGVFETLYEKAMGVVPVAA

SEQ ID NO: 8063 - protein, 408 aa, Unknown
  Description of Unknown: Chloroflexi bacterium sequence
MHIAFFTNFYHPVVNGVVRSVASFRQVLMEQGHNVFVFAQSESNYKDTEPFIFRYPSLPLPLPGDISAAIPVSPFVEQLLPALKLDIIHTHHPVLLGQTAARKAAELDLPLVFTFHTQYWEYTHYVPFPQEAIQDFLKNAVHRWLKDFMQKCQHIILPSESMKEILVRDYGLEDRYTVIPTGTDLEPYQCAKWKALRKEKGWQDETVLISVGRLAPEKNWDTLLRAFAKVYPGHPNLRLVLIGDGPARQTLEALAAELGIAEHVTFMGALPFEEVPCYLKAADAFAFASVTETQGLVTIEAMAAGLPIVAVDGSGTRDIVEHGKQGFLVANDVDALAKGIKKLLSDPDRMKRFSNNALKKANTFDVHQLGKQLISVYEQAIQDKKENRYVTLKMEEDSEQEAISPTQP

SEQ ID NO: 8064 - protein, 385 aa, Unknown
  Description of Unknown: Candidatus Methylopumilus turicensis sequence
MKILFISDVYFPRINGVSTSIRTFVKQMQDMGHTVHLIAPEYGIKTEDEAWIKRIPARSIYFDPEDKLMKYGVALDNLISLRKEKYDIIHIHTPFVAHYLGLKLAHLLDVPCVETYHTFFEDYLHHYLPFIPKGIAKSIARQISRRQCNAVDAIVAPSQPMLDVLRQYGVKSKAEVVPTGLQAHSFAKADGAAFRAKYGIAADRPMGLFVGRVAFEKNIGFLLQMWVDLIKKQPNALLVVAGEGPAEASLHALSKELNLEDNIKFIGYLDRNTELNACYQSADVFVFSSLSETQGLVLLEAMAQATPVVAIAELGTKSILIEGEGALIAPHDQVIFADKVYALLSDQARRDALGKAAYQYAKARWTDKAQAERMIHFYTDVTTSI

SEQ ID NO: 8065 - protein, 393 aa, Unknown
  Description of Unknown: Cryobacterium sp. Y50 sequence
MAADTFAPDVNGAARFAERLAAGLVERGHEVQIMAPAASRKHGSWTEMHEGQSMVVHRLHSWRWYPHDWLRFALPWLIRGQSRRILDAYRPDVVHFQSHINVGRGVSIEAAKRGIRLVGTNHFMPENMVKFSLVPLGFQDRVIMAAWRAARRTFGRASAVTTPTRRAAQFLEKYTGLTGIHAISCGINADNYSPNFDSRTENRILFVGRVTGEKQIDVLLKAVAKLNPDLDVQVEIVGGGDQKRNLEHLADTLGIRSRVTFAGYVTDEELRAAYSRATVFAMPSIAELQSIATMEAMASGLPIVAADAMALPHLVHDQANGYLFKPSDAQDLADKLTLVLTAPPEQLEALKRESLKLIAAHDIKRTLITFECLYRGEPVNNLVTNGASAHLPE

SEQ ID NO: 8066 - protein, 390 aa, Methylovorus sp.
MLREADVKILFISDVYFPRINGVSTSIRTFVGQLQELGHEVHLIAPDYGVQTEDEHWIRRIPARTIYFDPEDRLMKYGAALDKLMELRAENYDLIHIHTPFVAHYLGLKLGRLLDVPCVETYHTFFEDYLHHYLPWIPKAMAKGLARMVSRQQCNAVQAIVAPSRPMLDVLRQYGINSTAEVIPTGLQPHSFADADGAAFRTKYGIAQGRPVALFVGRVAFEKNIAFLVRMLTHLRQQQPDALLVIAGEGPAEDSLHAMSKQLGLQDNIQFIGYLDREKELNACYRAADVFVFSSKTETQGLVLLEAMAQGTPVVALAELGTKSILIEGEGALIAPEDEQVFAEKVRCLFSDEVKRKRLGESARQYAAKRWTSRTQAERMLQFYEQLISA

SEQ ID NO: 8067 - protein, 393 aa, Sulfurisoma sediminicola
MYRRHPNRFLRVLMISDVYFPRINGVSTSIETFRADLAAEGIHVRLIAPAYPQRHDAPATWRIPSRRVPFDPEDRLMHWQPLRHTAHHLAADGVDLIHVQTPFAAHYAGTRTARTHRIPVLATYHTHFEEYIAHYLPALPRPWLKAAARRLARGQCNDLDAVVVPSRAMHDTLTGYGVTAPLHVLPTGIPVHSFATGDGAAFRSRHDIPAERPVALFVGRVAFEKNIAFLIDAMATAVKIHPDLLLVIAGEGPALPALRRQATGAGLDGNVRFVGYLDRQTELPDCYAAADVFAFASRTETQGLVLLEAMAAGLPVYALAEMGTRDILDPRRGAVIAPDDPVAFGNGLATLIGNRYQLDTLAAEARDYALEWAAPARARQLAGLYRSLVTSAA

SEQ ID NO: 8068 - protein, 365 aa, Unknown
  Description of Unknown: Halobacteriales archaeon QH_7_69_31 sequence
MQTVAAFTDTYLPTVNGVTYTVRTWRDRWEARGGRMGVVYPRDDGYEPDPREFPVSSVAFPFYPGFRFGSPSVPAGAGDLDPDVVHAHTPFTLGLAARRLARARDVPLVVSYHTPAREYASYISDALAGVISRVADRYERWFFGQADAVVVPSATAATRLRTAGTPIHVVSNGVDVERFRPATEEADAAFRDRHDLPDGPLVGYTGRHGYEKCLEDLLAATEALDVGVALAGDGPARSMLESRAADRGDVRFLGFLNRDAVSGFYSALDVFAFPSPVETQGLVALESIACGTPVVAVDDGALSETVTDGETGYHYQPGDIDAFAAAIRRALDRQSRLGEQCLDARDELSVARSIDRLAAVYAAVT

SEQ ID NO: 8069 - protein, 384 aa, Kocuria tytonicola
MKILITAETYPPDVNGSAQFARRLAHGMLGRGHEVHVAAAMPTSGASRIMTDDGVVEHRFRSHHAFTHPYFRICLPWEIAREVSRLLDELRPDVVHVQCHYIVGRIMVREAVRRGIRVVGTNHFIPENIEPFLPFPQWFIRGYRKVSWWDIARVYGRCDVITAPTPLAVRTMVDNGVPDRAVAVSNGIDAGHYQAAADEQIQHPEHPVVLFCGRLAVEKNVNELIEALALIPREKNVHAEIVGEGEQRERLVKLAHERGVADRVHFLGFLTDDELRRAYLRADVFCQPGTAELQSLVTLEAMSASTPVVLANARALPHLADEGRNGYLFAPGSPGDLAHKLQLVLDAPPEQRRVMGEHSRRMVEQHSFARTLDTFERIYRGESR

SEQ ID NO: 8070 - protein, 658 aa, Amycolatopsis pretoriensis
MTALAIVCALVAAALFAVAAVRQHSEVTDLAVDGAPGLRTLARLLRSPGWWAGTGLAVGGSLLHVVALALAPLPVVQPLGVFSLVLTVLFGRNARRVVTAVVLVVAGVAGFVALAASATPAAAISAGTAELVAVAGFAVAGLAWFARAGCAALAAAAAVLFGLGSSVVHAAASQAPTTAILLGGQALLLLGAGGVILHRAYAAGPAAVVVGTTTVLDPLTAVAVAALAFGEVPRPAAALAAVVALAGVRVLAGAVPHVPSKTEEKPVHPTGLRVLIGADTFPPDINGAAFFAARLARGLAERGHDVHVVCPSDDGPARTEERDGYTIHRLRAHAIPFHRDYRFCTPGGARPAVGELLDRIRPDVVHVQAHFGVGRALLETAAARDVPGMATNHFMPDNLLGYTPFPRRVKNALARWAWRDLKRVYRDARIVTTPTPRAAEVLAGIGLDRPVQVVSCGIDLTHYAAPPRPADRPMSVLFVGRLDAEKNIDQLLRALAPLPHVRADLVGDGTRRHELQELTADLGIGDRVTFHGFVPDADLVHRYAAADVFCMPGTAELQSLATMEAMAAGLPVVAADALALPHLVHHGENGYLFAPGSITTISRWIADLAADPAVRARMGEASRAIVARHDIDGALAAFETQYRILTGLPAAAAVNRAA

SEQ ID NO: 8071 - protein, 393 aa, Agromyces flavus
MGADTFAPDVNGAARFAERLAAGLAERGHDVHVMAPAASRKHGSWKEVHEGQEITAHRVYSWRWYPHDWLRFALPWRIKQNAARILDKVKPDVVHFQSHIVVGRGLSVEAEKRGIRIIGTNHFMPENMLEFSLIPKAWQDWSVGLAWKAARRTFGRAEAVTTPTRRAADFLERYTGLRGVHAISCGIDAHKYFPNWEPRTENRIIFVGRVTGEKQIDVLLRAVTLLPAELDARVEIVGGGDQKRNLEHLAAELGIADRVTFTGYVTDEELREAYHRASVLAMPSIAELQSIVTMESMASALPVVAANAMALPHLVHDGENGYLFEPGSAEDLAAKLRKVLEASPEDYHALKEGSVRLIAAHDIQRTISTFENLYRGKPVTDPVTDVAPVAVPE

SEQ ID NO: 8072 - protein, 364 aa, Unknown
  Description of Unknown: candidate division MSBL1 archaeon SCGC-AAA259E17 sequence
MRIALATDTYHPQINGVVSSIDTIVEELEKEHEVHVFAPTESERAHSFRSFPFYPYPEYKIAYVRPEALAETFEEKEIEIVHVQTPFSLGVSALGASRRLSLPAVGTFHTLLPEYVHYLSRAPEFLLRKFGWKYITWFYGRFNAVTVPSKPIKKSLVRRGLENVYVIPNAVNTDFFHPGRNSSEANPSVLFVGRLAKEKNLKVLIDAAPTVLKEYPDTKFRIIGKGIHGDWYRELVKRKNLSSSFNFEGYVPSRELIEAYQECQIFAMPSTTETQGLVALEAMACETPVVGADARGLKDVISHGMDGYLFQPGDLEALSDYLLRLLSDDKSRKRMGEKARQKAEEFSSQKIGKQWTKFYSSLLG

SEQ ID NO: 8073 - protein, 426 aa, Rathayibacter sp.
MSDPRDASRPESSTGDSAPADAARRPLTVVIGCDTFAPDVNGAAKFAERLAAGLQARGHEVHVVAPSADGWSGTRVEDHEGQRIIVHRLFSLRWPPHDWLRFAMPWRIRQNSARILDEVKPDVVHFQSHVIVGRGLGQEAAKRGIRIIGTNHFMPENMLEFTLLPKAAQAKAVAMAWRAARRTFGRAEAVTTPTRKAAQFLEKYTGLQGVRAISCGIDADNYTPDFTPRTANRILFVGRVTGEKHIDVLLRAVSLLDPSLDAQLEIVGGGDQMRNLQQLATTLGIADRVHFTGYVSDAELKQAYSRATVFAMPSIAELQSIATMEAMASALPVVAADAMALPHLVHEGENGHLFEPGNAQALADGLTDVLTADPERLEALKRSSLRIVAAHDINRTISTFESLYRGEPVADPAADAASAPAGRAAS

SEQ ID NO: 8074 - protein, 418 aa, Nocardiopsis kunsanensis
MLRAAHPLSVLVVTDTYPPDVNGAAYFTHRLADGLAGRGHRVHVLCPSAQGQPHVTMAGEVTEHRVPSARIPLQPTMRAALPLGLRGHVDRLLARLAPDVVHVQSHFTLSRTALARARAAGIPTVLTNHFMPDNLYAHARVPRSLQSVAGSLAWHDMVRVAEQADHVTTPTPRAARLLREQGLRRGVEEVSCGIDLDRFHPRASERSAARARLGVPDRDSIVFVGRLDEEKRVDELVRALALITPDLDTQLVLAGTGQREEELAELARALGMEERVRFLGFVPDELLPSVYVAGDVFAIAGVAELQSIATLEAMSTGLPVVAADAMALPHLVAEGRNGYLFPSGEVEVLADRLRAVLSSRTERGFLGAAGREMAAEHDHRRSLERFESLYAHLGGAVLASVPSGPRVRGDRYARIVQG

SEQ ID NO: 8075 - protein, 409 aa, Arthrobacter alpinus
MNPPGVLSVSSTTSDSAQKPLTILIAADTYPPHINGAAQFCFRLATGMTARGHKVHVMACRADSGPMFTEERSEATVHRLRSRSVPTHEYFRISLPWEIKRDIKALFDVLQPDVVHVQSHYMIGEHVVYEAARRGIRIVATNHFMPENLNPFLPFPQWFKNIVGRVSWRDMGKVMSKADVVTTPTPLAAKAMHEHAFLRKVLPLSNGIESGNYELAEGETVPRNPYPTLAFVGRLAEEKHIDVLIDALAKTPADLNLHLVVVGGGEVKNALKAQAEKLGLSSRVSFTGLISDEELREVYLKADLFVMPGTAELQSLVTLEAMSASTPVVLANAMALPHLVEDGVNGYLFKPNDSDDLKEKITTIMRLSPEDRAAMGAASHSMVARHGLTKTLDTFEDIYRGGSYEDHAV

SEQ ID NO: 8076 - protein, 416 aa, Unknown
  Description of Unknown: Brevibacterium sandarakinum sequence
MLSAHRHTPVRRILIPTETYAPEVNGAAKFAERLAEGLAARGNDVHVACPSATGKASVSVEDGVTVHRMTSHRWPLHPTWTICMPWETKPELSRLLDSLQPDVVHTQAHFVIGRYAFSEASRRGIPVVATNHFMPDNVRPYLRAPKTLLDGGTAVAWWDLRRKFQSADFITVPTQLAADLLTQNGFSSPIRAVSCGIDLERFAHLRDDGSAHPEPASDRTVSGSDDEASSPPRVLFVGRLSSEKHAADIVEAVAKTDPALGLEADIVGGGDQEEPLKELAAELGIADRIHVMGKISDKELMDAYQRCTFFCMPSTAELQSIATLEALASRKPVVLADAVALPHLVRDGVNGFLFPPRDIEELAARFTHICELPDGELDTMARASLDVVAKHDIEYTLDTFESIYAGVIADRLDPAA

SEQ ID NO: 8077 - protein, 392 aa, Unknown
  Description of Unknown: Propionibacteriaceae bacterium NML 150081 sequence
MRILIGTDTYPPTVNGAANFSERLAHGLVGRGHDVHVVCPSPDAHVGPVERDGMILHHVRAFDYWAYKSFRVIYPWQAHPVSRQLIKVIDPEVVHLQDHFLIGRGLAHACRKYGYPLVATNHLVPENFFDHVPVPAPVRGIGSRWLWDDLERAFSCAAVVTSPTQKAVDLLEEATDMRALAVSNGIDVEPYAAAEQRWAAHRARADHVPTILFVGRLDQEKRVNDPIRAMAKLPADLPAKLEIVGQGGMRHEWEQLATELGLGPDRIEFRGFIDDDELLETYGRADLFCMPGVAELQSLVTMEAMAAGMPVVAANAMALPHLVRPGRNGWLYEPGDVEDLVARLTPLLRDGGLRQRMGEASKEIVASHAMATTLDRFEELYELAIRTQTARN

SEQ ID NO: 8078 - protein, 427 aa, Unknown
  Description of Unknown: Opitutaceae bacterium EW11 sequence
MMTNTYLPHVGGVARSVSTFAEEYTRRGHRVLVVAPEFEGKPLPKRAEALVERVPAIQKFNGSDFSVRLPIATVMSERLDVFPADVVHAHHPFLLGDTALRIAASKNVPVIFTHHTKYEDYTHYVPFNSPALREFAINLSTHFANLCDGVIAPSESIADLIKSRGVEVPIRVVPTGIDVKLFSSGDRERFRRKYGFGDDILVVGHVGRLAPEKNLEYLAEAVAQYVASQPSARFFVVGAGPSEDVLKEAFTRRGIAKSLVMAGKLTGPALVAAYRAMDVFAFASKSETQGMVLAEAMAAGLPVVALDASGVREVVRHGRNGYLLPEDASPRRFASYLKRLHLNPRRRAAFVAQAARTAETFSREHCAEQALAFYDEILRATRRDRLLNWLNPWGVMLERLNVEWNLLAQKAQSVVEAVTASSEQKAS

SEQ ID NO: 8079 - protein, 391 aa, Unknown
  Description of Unknown: uncultured prokaryote sequence
MSAQTGPGKGDRGLAVGMFTDSYRPRLSGVVHSVAAVTRALREQGHRVVVFAPRHPGYRDDEPDVVRLPSVVTSRYPDFPLLVPLVGDLDRRVRDLGLQVVHAHSPFTAGRLAAASRGRCPLVFTHHTLYEHYVHYAPLVPGFLARQWVRWHVVRFCNRCDLVVAPTRAVSEFLRVRGVRSRVEVVETAALDLGALRRVPAADPTACGIPPGAPLVVSAGRMAPEKSMDVVLEAFARTRGLQDAYLVLAGGGPSLDVLRQLARRLGVEARVRFLGPLPWEGVVAWMKAAWVFAFASRTETQGLVAAEALACGTPVVAVRAGGVAEVVDHGRTGLLVDPSPDLLGQAMARLVGDEGLRRWMADQARQESERFSARRVAGRLVELYRSLLDAA

SEQ ID NO: 8080 - protein, 444 aa, Rathayibacter sp.
MGPRREPRNRPTSADRSLLSPSGTTPIGPPVSDPRDASRPGSPDSRPLTVVIGCDTFAPDVNGAAKFAERLAAGLAQRGHEVHVVAPSADGWSGTRVETHEGQRIIVHRLYSWRWYPHDWLRFAMPWRIRQNSARILDEVKPDVVHFQSHIIVGRGLGIEAAKRGIRIVGTNHFMPENMLEFTLLPKAVQAKAVAMAWRAARRTFGRAEAVTTPTRKAAQFLEKYTGLRGVHSISCGIDADNYTPDFEARAGNSILFVGRVTGEKHIDVLLRAVALLDPALDAKLEIVGGGDQMRNLQQLATTLGIADRVRFTGYVSDADLKEAYTRATVFAMPSIAELQSIATMEAMASALPVVAADAMALPHLVHDGENGYLFAPGSAEALAERLTAVLTADREDFEAMKRASLRIVAAHDINRTISTFESLYRGEPVAVPASDAASAPAAT

SEQ ID NO: 8081 - protein, 401 aa, Nonomuraea coxensis
MPLHSVTDRALLAPAPERPRRVLISTDTYPPDVNGAAYFTHRLATGLAARGNEVHVVCQSEHGPASADVVDGVIVHRLRSAPLLVHPTMRVTVPARLDRLVADIGPDVLHTQGHFVVGRAAIAAARRAGVPVVATNHFMPDNLFQFAHIPARLRAKAGRLAWRDFARVFNRADHVTTPTPLAARLLADQGFAREVEPVSCGIDLSRFHPHAEPKAWARKLFGLPDRPTVLFVGRLDEEKRIDELVRALPLVLNETDAQVALVGKGNQRAELERLAARIGVGDRVFFLGFVPDENMPQAYAAADVFAMPGVAELQSIATLEAMATGLPVVAADAMALPHLVVCNGHLFQPGDVVELARHLTRVLGDDELRARYGRASRELALTHDDQASLARFEAIYDEVAR

SEQ ID NO: 8082 - protein, 311 aa, Unknown
  Description of Unknown: Candidatus Rokubacteria bacterium sequence
MTDTPVRVALFTNNYLPFCGGVTVSVETLRAGLEAAGHEAWVFGPRLAAAADGSPRVVRYPSIPAATYPEFALAVPYSRRITRLVASLEFDVFHAHHPFLLGPAARRLARRWRRPLVFTYHTRYEKYAHYVPLRRPLVEALAVRLSTRFAARADAVIAPSAVIRDELQARGVATPIAVVPTGVDLSRFRPGDRGAARAALGVPGDDPLLLYVGRLDREKSVDRVLLAFERVASTLPAARLILVGRGTEAARLERLARSLPVADRIRFCGARPHAMLPSCYQAADVFLFASETETQGLVLVEAAACGLPAVA

SEQ ID NO: 8083 - protein, 923 aa, Unknown
  Description of Unknown: Nitrospiraceae bacterium sequence
MITLNEEKNMARALSSCSFADEIVVVDGGSTDNTLNILKAHEKVVLIQHPWEDHFGKQRQVSLDHCTGEWVIRLDPDEAFSREFEDNIRNLLSSTTPDVTGYNIRQCNLVGNEKYYSKAFDNFETNPRIWRNLPVIKWEQKIHEILGGLYGRIGQWDVYVVHYGFLDKERYRQKGRYYSQLKESGFENPDELYFREYDIQQRPVRAATAPYVPAYNMEESIEGLPEVAIVRGPNLNQWETQNYEPLSDKFNITLYSSDKPAFDLTRINLPVVKLPSHPEDRAYMKGLEFELFDKDIIYTADITWMFTYQAVIAKHKFGKKVIALEWENIPFAHEENEIVQEIKQQNRDLVDVFVAVTKRAKDALLLEGVPEDKIVVIPMGIDTTRFRPDKETGIRVRKDLGIAEEEKVVLFTGRMVWEKGIYDLVHAAKLVTLDKSIKTLPLRFVVVGRGQEAQEIKKIVSKLCMNNIFLFIESHPYSRMHEIYNMADIFVLPSIAIRNWKEQFGMVLAEAMACGVPVISALSGSIDEVVADAGLLVQPNDPSGLSSALVNLLKDELLRKELGIKGRERAVREYDSRKIAGKFAALFEDVFKSTFKGAVSELAEYTRLKDNDILKRIRSVYSSQIQEWKSVIGEQLTQDRVLEFYRRTDSYLFDLVQYNYENPYYARWTEDLFNFCAGLNNEKEELKILDFGGGIGSQIISLSKLKGAKLSYADIPGKTFEYAGWRFNRRHIDIDMIDAGKEDFLEERIFDVVITLDVVEHLVDPEAAVRYLVSHIKPDGYLVVVTSFVDNNGEAGWHLNSDRYTDEAFYNFIKSFGMEMLNNGYPRIFQKSNELVDLLAEIASATGEGRSADSRRHLESYLQLQPFDLDMLVKHADVCLKLGDMDTASENIEKVLLLNPGMPEALEIAEKIKSKDNENTSCK

SEQ ID NO: 8084 - protein, 437 aa, Subtercola boreus
MSASSGTNPASADAVPAKPLKIIIGADTFSPNVNGSARFSQRLASGLAARGHEVHVVAPSASRKHGTWTESYDGQDITVHRLRSFRWYPHDWLRFAEPWFINKNSDRILAEVEPDVVHFQSHIIVGRGLSIAARKRGNVRVIGTNHFMPENLLEFTLLPKSWQEKAVGMAWKAAKRTFGRADVVTTPTQKAAEFLEKSTGLDGVLAISCGIDADNYTPSFERRTANRILFVGRVTGEKQIDVLIKAVSLLPSDLDVQLDIVGGGDLLKHLENVSKTLGVDDRVHFSGYVTEDELREAYTNATIFGMPSIAELQSIATMEAMASGLPVVAANAMALPHLVKDGVNGYLFAPGDAQQMADRIESLLRLPQDELDAFKKASLKLIEKHDLVRTIVTFERLYRGESTVDVAAIDEIMAAESLNTSSIRIVDVAPEQSDAAH

SEQ ID NO: 8085 - protein, 395 aa, Pseudonocardia sp.
MRVLIGADTFPPDINGAARFTARLAAGLAGRGHEVHVVAPSDTGPASSPVPAAGMTAVHRLRSYRVPGQDRFRACLPGPAAAGAQRVLRAVRPDVVHVQSHFQVGRGLLAAASAAGCPTVATNHFMPENLLQHARVPDVLAERVSRWAWRDLARVYGAADVVTAPTPRAVELLGARAGLSGRAVSCGIDLSRFGTGGVEPEPASEPTVLFVGRLEREKRVDELIRAFALVTGPARLEIVGDGTRRAGWSALARDLGLADRVRFRGAVDDDALVAAYRRCAVFCMPGIAELQSLVTLEAMAAGRPVVAADAVALPHLVHPGRNGLLYRPADVAGLAAALTALLDDPATRARMGAAGREAAAAHDLDATLDAFEDVYSDVRRGAARGRVRRPVAGVV

SEQ ID NO: 8086 - protein, 398 aa, Nesterenkonia massiliensis
MNSGKPLRILIAADTYPPDVNGAAVFGYRLAKHMNARGHEVHIAAARPGPGPDTVEQRDEATIHRFRSFKAPTHEYYRLCLPWLVEPAMGRLMDSIEPDVVHVQCHYMIGKAAIEAAEARRIRTVATNHFMPENLDPFLPFPRWFKRIVSANSWRDMGRLMGKASVVTTPTPLAARTMVEKAGFDRVLPLSNGIDVDYYTVRPGENVPTRDKPTVLFVGRLAVEKNVDVLIDAISKTDPALDISLEIIGDGEQRDKLRDQVETLRLQDRVNMRGHVDDVELRRAYIAADAFCQPGTAELQSLVSLEAMSAAKPVVLANALALPHLVSEGENGYLFEPNNSADLAEKLNQIFRKSAVERAAMGAASREKANQHAIGKTMAAYEALYEGADWVELDQFHA

SEQ ID NO: 8087 - protein, 388 aa, Desulfovirgula thermocuniculi
MKIGIFTDSYLPYTSGVVRSIETCNAELRSMGHETLIFAPGYKNYSQEEEGVFRFPSVPAPTNRDFALAIPFSPRFKPLIEQWRPDIIHVHSPFLLGRLGARQARRLKVPLVFTFHTLYDQYVHYFPFARSLAREATRQLCRAFCNRCDLVIVPTSIIARYLQDMGIRTRIKVIPTGIKLEEYAGGEKSWLRHKLQLPPGEKILLFVGRLGKEKNIDFLLASFAHLVQEFEAARLVLVGGGPEEENLRKRARHLGIAGKVTFMGPLPKKEVINCYAGADVFVFSSKTETQGLVLAEAKAAGLPVVAVKAFGTAEMVDDGRDGFLTPEDSNAFTAKIKELLTSDQLRQQMSEEARKNARLLSSRHTAQMLMEEYQGLLAKRNHPSPCRP

SEQ ID NO: 8088 - protein, 484 aa, Halomonas sulfidaeris
MPFRVAISGHKSPHNMPPLRRHSNHNTLDESEFAAFSKARSQALSQALSQALTHLAKGNALAQHREAERETRLASALTRFHSTAPTTAMPLKGMKVLMISDVYFPRVNGVSTSIASFRGALERLGHSVTLICPDYPVGQVDEPGVLRIPSRRVPGDPEDRMMRYRDLLALAPSLAVEAFDLIHVHTPFTAHYAGVALGRRLRLPVVATYHTLFEEYIHHYIRWLPRRWLRFAARRLSVHQCQQLDALVAPSRAMQQALTHYGVTTPITVIATGLALEAFCQSQDQRDFRAHYDLPQEARRLLYVGRAAFEKNIDFLIDMLPQVLAEHPTTRLIITGEGPAHDSLVKRAQEMGVADAVLFLGYLDRNGPLQAAYRAADVFVFASRTETQGLVLLEAMALGTPVVSTAMMGTLDVLKEGEGCLIAKDNHDDFATKVNRLLSDESLRQQLAERAQVYAASWHEDAKSAELITLYHQLTAERCKSTDT

SEQ ID NO: 8089 - protein, 392 aa, Unknown
  Description of Unknown: Salinibacterium sp. CGMCC 1.16371 sequence
MGCDTFPPDINGAANFASRLGAGLTERGHEVLVVAPAFSRKRGRFIEDHDGSRFAVERLFSLRWYPHDWLRFAMPWNSQANAARILDSFQPDVVHIQSHILVGRGLARQAVKRGIRVVATNHFMPENMIEHTLLPKFVRKPAIRMAWKDASKTFALCESVTTPTRKAAVFLESETELTDVHAISCGIDASLYSQNMDKPAENRIVFVGRVTGEKHIDVLLRAVATLDPSLDVKLDIVGGGDQLSALKQLAVSLGIRDRVDFTGYVSDQELRSILTRASLFAMPSIAELQSIATMEAMASGLPVVAADAMALPHLVHDGENGFLFTPGDAADLAEKLTRVLEMPWDQVLAFKKASLKLIVPHDIQRTLTTFESLYRGESVTDPATDVSLGESA

SEQ ID NO: 8090 - protein, 374 aa, Promicromonospora sp.
MNGAARFAGSLANGLARRGYDVHVVAPSPTGRPMREERDGVVLHGLRSRRYPSHHNLQVCLPWETRRGIAEVLEEVEPDVVHTNGSYILGRALVDAAHRAGLPLVATNHLMPENLVGYLLVPSSMHRKVGQWLWQDIGRVYSKADVVTAPTPRAVDLLAQHAGLTHAVPVSNGIDTDRYTTTNRDGHAEPTVLFVGRLDQEKRVDEIIRAFALLPDDLPGRLEIVGTGTKADDWAALAASSGVTGRVRFRGYVPDDELLTAYSEADVFCMPGVAELQSLVTLEAMASGLPVVAADAMALPHLVRPGVNGWLYTPGDVRELANRLGDLLADAGLRHRMGAASRELVAAHAVDGTLDAFEGIYEKVRAMRNQPATA

SEQ ID NO: 8091 - protein, 396 aa, Thermostaphylospora chromogena
MRVLIATDTYPPDVNGAAYFTHRLATGLAGRGHDVHVVCASDRGPARDERVNGVLLHRLRSASVLVHPTMRVAVPSRLDSLLSAVAPDVVHVQGHFITGRAAISAARRAGVPVVATNHFMPDNLFQFAHVPQRLRGIVGRLAWRDFGRVFARADHVTTPTPIAARLLAEQGFTRDVEAVSCGIDLTRFRPPARPKSHARNLLGLPDRPTVLFVGRLDEEKRLEEAVRALPLVRNVTDAQLALVGEGRCRQELEWLAARIGVGEHVRFCGFVPDELIPEVYAAADVFCMPGVAELQSIATLEAMATGLPVAAADAMALPHLVRPGETGFLHRPGDVQALARHLIELLTSDEKRAEMGRAARRIAMTHDHQASLARFEDIYRSLSAARRTAAEEEAPL

SEQ ID NO: 8092 - protein, 385 aa, Thiorhodospira sibirica
MKILMITDVYFPRINGVSTSIATFKQAFEAAGHQLTLIAPQYLAPYDDDAAIIRVSSRRVPFDPEDRMLKYREVLALAPTLAAEGYDILHIQTPFLAHYLGLKLARRLDIPCVESYHTYFEEYLFHYLPLVPDAWMRALARQFSRGQCNAVNAVIVPSRAMQTVLQNYGVATPQHVIPTGIPLELFAHGDGQAFRQSLGIAPHTPVLTHVGRIAHEKNVDFLLRVVQRIKAQQPDVMLLLTGEGPALAHIKQLAATLGLNDNIRFLGYLDRRTRLADCYAAGDVFIFASRTETQGLVLLESMAAGVPVVALSIMGTRDILEPGLGALVAQDDEADFARQVLTLLQDRALRERLSHEARDYATRWSVPHTAQQTLAVYAQCVAARR

SEQ ID NO: 8093 - protein, 398 aa, Prauserella muralis
MRVLIATDTYPPDLSGSSFFADRLARGLAARGLDVHVVCASDTGPRTDVVRDGVALHRLRSVPLLIHPTVRFVPPPGVHGVLRRLVARVRPDVLHTQDHFTIGRAAVAAAVRSGIPVVATNHFMPDNLLPYLPRWLHAAVSWLAWRDFHRIYRHADHLTTPTRVAADLVARTGFEREVEPVSCGVDLSRFRTPAASATDPRMWARKELELPDLPTIAFVGRLDAEKRLDELIRALARITARVRAQLVLAGRGTRRAELERLACAEGVREHVHFLGFVPDEQLPAVYAAADVFAMPGVAELQSIATLEAMASGLPVVAADAVALPHLVSPGENGFLFTSGDVAGLAAVLTRILTSPELRDRMGAVSLAMASRHDQDRTLERFEEIYAAVSAGRGPAAKG

SEQ ID NO: 8094 - protein, 416 aa, Allokutzneria albata
MTSNRPLRIVIGADTFPPDVNGAANFAHRLAVGLASVGHEVHVLCPAPSASAPMLAGVNAVDGITVHHLKSYRWPFYDDFRFSVPWKAKAETEELLWQIRPDLVHVQAHFVVGRALSKTAPALGIPLVATNHFMPENLFAHAKVPRWLRSTAAKLAYRDLAKVFGRAQMVTAPTPRAVELLHANKLGQEALAISCGIDIQKYRGGTPVARTPGATKTVLFVGRLDEEKRVDELLHAIAKLPEHIDVRAEIVGGGSCEKSLVELAGKLGITDRVRFLGRISDEELVQAYARCDLFCMPGIAELQSLVTMEAMAAGKPVIAADAMALPHLVRPGHNGWLFPPGNVLVLAARLAQTLGDEDMLRRMGAASAEMITEHALAATLERFESLYRKVIADAKGSIRLVPKIEPAAPTTLPRSA

SEQ ID NO: 8095 - protein, 390 aa, Pseudomethylobacillus aquaticus
MKILFISDVYFPRINGVSTSIRTFVHEFQALGHHVDLIAPDYGITTADEHWIKRIPARGIYFDPEDKLMRYGQALDRLIELRRANYDLIHIHTPFVAHYLGLKLAHLLDVPVVETYHTFFEDYLHHYLPWLPSGFSRSFARFVSRRQCNAVDAIIAPSQPMLDVLRAYGVKTLAEVVPTGLQAHSFVEGDGARFREQHGIPAERPLLLYVGRVAFEKSIDFLLHMVDVLRKQQPEVLLVIAGEGPAEASLHALNEQLGLQANVMFIGYLDREKELNSCYHAADIFVFASRSETQGLVLLEAMAQAVPVVAIAELGTRSILVEGQGAHIAEADVQQFAGRVHQLLQDHEERAALGQAAHHYASKHWTSRAQALRMLQLYQRLIEPRSNFPD

SEQ ID NO: 8096 - protein, 399 aa, Stackebrandtia nassauensis
MIPGTRRVLIASDTYPPDVNGAGYFTHRLAAGLAARGNEVHVVCPSPDGPAGRETRDGVTVHRLRSHPLLLHPTMRFVVPAAVNRAIREVVTAVAPDVVHVQGHFPVGRATLKHAARVGIPTIATNHFMPDNLLHHVKVPTRLRKWVASRAWRDAAAVFARADHVTTPTRLAAEVFRDNGFTGHIEPVSCGIDLSRFHPRSTSATAARARLDLPDRKTILFVGRLDEEKRVHELIRALPSLRRRVDAQLVIAGTGPQGPALTRLAADLGISAYVRFLGFVPDADLPGVYRAADLFAIAGVAELQSIVTLEAMASGLPVVAADAVALPHLVRNGHNGFLFTPGDIDGISTRLEVILESADEIAAMGAASRAMAAEHDHARSLARFEEIYTHLAAPARSRI

SEQ ID NO: 8097 - protein, 399 aa, Serinicoccus chungangensis
MRVHPSAHPHPPPGRRRVLLLTDSYRPTVNGVVSSVDELRQGLLEAGHEVRVLTVGPTRRTTFDGQVYRLPSLDASHVYPHARLGRPVDGPLLADLVRWRPEVLHSHTEFVAFWWARRLAHRVAVPHVHTYHTLYADYTHYFCPHERLGRSLCAAFARHTLDRTDLVIAPTEKIRRLLQGYAVRPPVEVVPTGVDLARFAPGAGSPELRSALGLEPGVPVVLSLGRLAAEKNLAEVVDLLARVPDPWQLVVAGDGPEAGALHRQVGRLGLGDRVRFVGAVEPSRVPELYRLADVFVSASRTETQGLTVLEALATGVPVVCRDDAAVDGVVVAGRNGERYTTPEEFTRAMTRLLRDPDLRRRWGREAVRTATGLGRDGFVAAVCSAYDRAAGRDSTTVAA

SEQ ID NO: 8098 - protein, 393 aa, Agromyces sp.
MGADTFAPDVNGAARFAERLAAGLVERGHDVHVMAPAASRKHGTWKEVHEGAELTAHRLRSWRWYPHDWLRFALPWRIRQNSARVIDQVKPDVVHFQSHIIVGRGLSIEAEKRGIRIIGTNHFMPENMLEFTLLPKAWQDWAVGLAWKAARRTFGRAEAVTTPTRKAAQFLERHTGLVGVHAISCGIDAHKYAPNWEPRTENRILFVGRVTGEKQIDVLLRAITLLPASLDVKVEIVGGGDQKRNLEHLAVQLGIADRVTFTGYVTDEELREAYHRASVLAMPSIAELQSIVTMEAMASALPVVAANAMALPHLVHHGENGYLFDPGNPQDLADKLRMVLEAEPDDYNALKARSVKLIKAHDITRTLDTFESLYRGQRVTDPVTESIPVILPD

SEQ ID NO: 8099 - protein, 405 aa, Kutzneria buriramensis
MTSTAPAPAIGAEATPPRLRVVIGVDTFPPDVNGAANFASRLAAGLAGRGHDVHVLCPSTTARSTTESDGTLTVHRVSSLSTPVHPTFRISRPLRASRTAEALLTELAPDVVHVQAHFVVGRALAAAARRHDIPLVATNHFMPENLHGYLPMPKGLRAALSRLGWWDLRRVLSSARTVTAPTPRAVQLLAEHGIPDAIAVSCGIDLTRFPASPAPDHLVPHVLFVGRLDEEKRVDEILLAVHRLRRTAHVRVEIVGDGKCRRAWQELAGRLGIAGDVTFHGHVDDDALLAAYRRADIFCMPGVAELQSLATMDALAAGKPVVAADAMALPHLVLPGETGWLFPPGDIAALADRLRDLIGDPAARARMGAAGRELIGRHTLDGTLDRFEALYRNALMPARRGFFVR

SEQ ID NO: 8100 - protein, 433 aa, Allonocardiopsis opalescens
MSAVDQAVPAEPTRKRILIGTDTYPPDVNGAAYFTARLAEGLSARGNDVHVVCPSPDGPPRIERRNGVTLHRVRSASVLVHPTMRTALPLGLAGTLRRLLDRFAPHVIHAQGHFVIGRTLISAGRRNGTPVVLTNHFMPENLFHYAHVPGPLQGPTGGLAWRDFVRVMGTVDHVTTPTAKAARLLLDKGFGHPVEAVSCGIDLSRFHPRPERGAKARAMLGLPERETVMFVGRLDDEKRIDDMVRALPMIAKVRDAQLALVGTGSRRAALEQLAASLGVADRVRFLGFVPDDELPMAYQAADVFGIASIAELQSIATLEAMASGLPVVAADAMALPHLVDEDRNGYLYPPGDHGAFAHRVLSILESGPKRAAMAEASLEIARRHDHERSLARFEEIYDTVRPGVGIDRRRRRVAVSSGSPVVVERARARELTR

SEQ ID NO: 8101 - protein, 394 aa, Unknown
  Description of Unknown: unclassified Leifsonia sequence
MGCDTFAPDVNGAARFAERLAAGLVEHGHDVHIVAPAASRRHGTWVEEHQGQKMTVHRLRSWRWYPHDWLRFALPWTSKANARRVLDQVKPDVVHIQSHIVVGRGLAAEAEKRGIRIVATNHVMAENVVEFTLLPKFLQKTFVKLAWADARPTFDRAEAVTTPTRKAAEFLERSTGLRDIHAVSCGIDAHNYTPDFTPRTANRILFVGRITGEKHIDVLLKAMKLLPATLDAHLQIVGGGDQLKNLQTMAETTGITDRVEFLGYVSDQQLREAYSRATVFAMPSIAELQSIATMEAMASALPVVAADAMALPHLVHDGENGYLFRPGDAQDLADKLERVLTMPQEELDVLKHGSLRIVAAHDIQTTISTFESLYRGEPVADPVTDAAPSVPAPE

SEQ ID NO: 8102 - protein, 391 aa, Diaminobutyricimonas aerilata
MGCDTFAPDVNGAAKFAERLAAALVRHGHEVHIVAPAASRKHGTWTEVHEGERMTVHRLKSWRWYPHPWLRFALPWQIEANSRRILDEVKPDVVHFQSHIVVGRGLSVAAIERGIRVIGTNHFMPNNALQFTLIPEAFQQRAVKAMWRAAQRSYLRAEAVTTPTRRAAEFLEANTSLHNVLAISCGLNVSDYTADLGPRTDHRVVFVGRVEEEKQVDRLIRAVAQLKDELDVQLEIVGDGDQRRPLEALATELGVRDRVHFAGRVSDEYLRAALTRASVFAMPSIAELQSIATMEAMASGLPVVAADAMALPHLVHDGENGYLFEPGNADELAARLRDVLTATPERYREMQQESLNIVAAHDIENTVRTFERLYRGEPVGANGAPAGNSAH

SEQ ID NO: 8103 - protein, 456 aa, Halomonas boliviensis
MPQRRRPPLNSPLSDQEVAALTQLANGNALHQQREADREAQLASRLPLFHSTASACEAQPGGMKILMISDVYFPRVNGVSTSIASFRGALERLGHSVTLICPDYPLGQVDEPGVLRIRSHRVPGDPEDRMMRYRDLLALTPQFAGKAFDLIHVHTPFTAHYAGVALGRRLGLPVVATYHTLFEEYVHHYIRWLPRRWLRWAARRLSVHQCQQLDALIAPSRAMQDALSRYGVTTPTTVIATGLALESFCHTQGAQHDSDFRAHYHLPQEARLLLYVGRAAFEKNINFLIDMLPKVLAEHPTTRLIITGEGPAHDSLVRRAEEIGLAESVLFLGYLDRNGPLQAAYRAADVFVFASRTETQGLVLLEAMVLGTPVVSTAAMGTLDVLKEGEGCLIAEENHDDFASKVNRLLSDDTLRQQLAERAQSYAASWHEDTKSTELVSLYRQILGASLINMSK

SEQ ID NO: 8104 - protein, 393 aa, Unknown
  Description of Unknown: Cryobacterium tepidiphilum sequence
MAADTFTPDVNGAARFAERLASGLAARGHDVHVMAPAASRKHGTWVEVHDGQSMTVHRLFSLRWYPHDWLRFALPWTIRRDSRRILDSVKPDVVHLQSHINIGRGLSLEAQKRGIRTIATNHFMPENMLEFTLIPKRMQNWAITVAWKAASRVYARVAAVTTPTRRAAEFLEKYTGLTGVHAISCGIDADNYTPDFGPRTENRVLFVGRVTGEKNIDVLLRAVTLLPADLDARVEIVGGGDQKRNLEHMADTLGIRDRVTFTGYVTDEELRAAYTRSTVFAMPSIAELQSIATMEAMASGLPVVAANAMALPHLVHDGENGHLFEPGNPQDLADKLATVLTAAPEELTAMKRESLKLIEAHDINRTLSTFESLYRGESVTDPITDETAARSVE

SEQ ID NO: 8105 - protein, 386 aa, Saccharomonospora halophila
MRILISTDTYPPDVSGSSFFAHTLAVGLADRGHDVHVVCASDEGPRRDVREDGVLLHRLRSVPLVIHPAVRFVPPPGVPAQLRRLVPGIAPDVLHTQDHFTIGRAAVRAARRHDIPVVATHHFMPDNLLPYLPRRVHAPIARRAWTDCLRVYEHVDHVTAPTRTAAELVTGRGFDRVVEPVSCGVDTDRFRPPDGPRGPLRKELGWPDLPTVVFVGRLDAEKRLDELIRAWPAVTHHVDAQLVLVGTGTRRGELERLAEHTGVRHRVRFPGFVPDALLPTVYRAADVFAIPGVAELQSIATLEAVASGLPVVAADAVALPHLVSPGRNGFLFRPGDVDGLAGSLVRLLTSDDLRTRMGTAGRTVAAAHSRTRTLERFEEIYRTLLR

SEQ ID NO: 8106 - protein, 406 aa, Micrococcus sp.
MSDRPGIAADRPLKVLIAADTYPPHVNGAATFGHRLATALHARGHEVHVVMPRSDAGPDTVEHRPEATVHLLRSLPAPTHEYYRVVLPRHAKISFRRIYREVQPDVVHAQCHYMIGEAAINEAERRRIRIVSTNHFMPENLEPFLPFPQWFLDIVSRVSWKDMGRLMGKGAVVTTPTALAAQAMAEHAGLDNVLPVSNGIDASAYELQPGERVDHPGHPVVLFVGRLAVEKNVEVLIRAIAHLARTRPDLDVHAEIVGDGEQRDRIRATVDEEGAADRVLLRGHVSEEELRAAYLRADVFCQPGTAELQSLVTLEALSASTPVVLADALALPHLVDEGVNGHLFPPGDHVALAERIARILDLSDADRAAMGEASHAKALHHSAQKTVDIFERLYRGATAAEVRALL

SEQ ID NO: 8107 - protein, 400 aa, Halomonas taeanensis
MKILMISDVYFPRVNGVSTSIESFRRALTRLGHSVTLICPAYPVGHEDDPGIRRIHSRGVLTDPEDRMMHYRRILALAPELAAQGFDLIHVHTPFVAHYAGRALGARLGLPVFETCHTLFEEYLHHYLTWLPASLLRFAARRVAVRQCQTVAALISPSTPMREALVRYGVSRPISVVATGLPVEAFAAGGEGQVSAADTRRGFDIDAEAPLLLFVGRAAHEKNIAFLIEMLPRVLACHPHATLVVAGEGPARQALARQARAAGVEASVRFVGYLARDGELQALYRAADVFVFASRTETQGLVLLEAMALATPVVSTAVMGTRDVLCDGEGCLVAEDDESAFAATVNRLLEDPALSSELAQRAVVYAGRWHEVAQATALLECYQSQLAPKEEVALPSIGSP

SEQ ID NO: 8108 - protein, 458 aa, Unknown
  Description of Unknown: unclassified Plantibacter sequence
MLEHGVPRRIRVVSDRPHPLTSLAKHRGITDTLTSPDDQHLAKASSTTPTPDTHKPLRVVIGADTFSPDVNGAARFAERLAAGLVRRGHDVHIVAPAGSRKFGTWKETHEGQTMTAHRLFSLRWYPHDWLRFAMPWSMRRNARKILDRVKPDVVHLQSHIVVGRGLSIEAEQRGIRMVATNHIMPDNILDFTVIPKRTQEWLVRTQWAAARRVFDRAFAVTTPTRKAADFLEQFTGLTGVHAISCGIEAGQYTPSFEPRKRNTILFVGRITSEKQIDVLLRALTKLPKELDAHVDVIGGGDQAKNLEQLTQQLGIGDRVRFLGKVSDDEVKQAYTNATVFAMPSIAELQSIATMEAMASGLPVVAADAMALPHLVHDQVNGYLFEPGNVDALAERLATVLSASPEEYRRMQDASLELVSAHDIERTLDTFEALYRGEQVVDPTTERHTATADRQESAD

SEQ ID NO: 8109 - protein, 430 aa, Halomonas shengliensis
MFTNTYLPIVGGVSESVQRLAVSLRELGHRVLVVAPRLDGQAETEEGVVRVAAVQHFNGSDFSLPVPIPGQLHEAVEAFDPDIVHSHHPFLLGDTAARTAETYGLPLVFTHHTLYEHYTHYVPGDSPRMQRFAVALATEYTRLCDEVIAPSESIRRLLIERGANAAISVVPSGVDMSRFAAGDGRAWRERLGIPEEACVVGHLGRLAFEKNLDFLARAVGLALERDERLHCLVVGEGEARPAMEACFDEAGVGARVHFTGRLQGQALIDAYHAMDLFAFASHSETQGMVVAEAMATGLPVVALDAPGVREVVRDGENGCLLEADDAEAMAAALAALVEPAARAPLAEGAERTAAAFDEARCAERCLEVYRRAIAAGGPFTHAEEGGWERVRHRLGAEWQMLRHRGRVLGKLVHATWEEERPDWWPGGPAK

SEQ ID NO: 8110 - protein, 933 aa, Unknown
  Description of Unknown: Nitrospiraceae bacterium sequence
MKISVSMITLNEEKNITRALSSCSFADEIVVVDGGSSDGTIEILKAHDKVVLIQSPWKNHFGRQRQVSLEHCTGEWVIRLDADEAFPQEFEEGIRKLLSSTPADVVGYNIHQCNLVGNEKYYSKIFDNYETNPRIWRNRPAIKWELQVHEILVGLSGTIAQWDVFVVHYGFLDKKRYWQKGEYYTQVPESGIYRQRPEKLFYREYDIQPRPPRSAVAPYVPEYKSEVDPDGMPEIAIVRGPNLNKPEVQNYESVSDKFNMTLYSGDRPNFDLAHIKLPVIKLPSDPEDPAFLKGLEFELFDKDIIFSADILWTFTEQAILAKHKFGKKVIALECENIPFAYEDDGLMREMKQFNRRFTDVFVAVTTRAKDALLLEGVPGEKIVVIPLGTDIERFSPDEAAGKRTRKNLGIAEEEKVVLFSGTIAWEKGIYDLAHAARLVTLEDSIKAVPLKFVIAGQGPESQNIKKCIKELGMDNIFTFIDCYPYHEMQELLNAADIFVFPSIPTKAWREQFGMAVIEAMACGTPVVSTVTGPMDEIVADAGTLVQPNDPTTLSAAIIRLLKDDPLRREFGKKGRERAVREYDSKKIALKFASLFERVFETTYKGALRELAEYTHLPVKDILNRIRSIYSRQVEEWRGLIGDKTTRDKVREFYRDTDSYLFDLVQYNYENLYYMKWTEDIFNFCAELKKQKGDLKILDFGGGIGSQLIALSALKNAELSYADIPGKTFEYAGWRFNRRHLAIDIIDATRGDFLAGRMYDVVITLDVIEHLVDPEAAVEYLLRHIRPGGHLIIVTSFVDNNGEAGWHLNVDRYTDDSFYNFIEKQGMEMLNEGRLPRYFRKPFEDPDDLRPQIYSAISEERFADARNLMETHLEMHLLDLGILVRHAEVCLKLGDCRAASESIEKVVMFSPDMPEAVEIAKEIRRRDNENTSCK

SEQ ID NO: 8111 - protein, 392 aa, Humibacter albus
MGADTFAPNVNGAARFAERLAAGLVERGHEVHIMAPAASRRHGTWYEEHEGARMLMHRLPSWRWWGHWLRFTLPWAIKGKSARVLDEVKPDVVHFQSHFVVGRGLSIEARKRGIRVIATNHFMPENLIDFAHIPHGLRQLAIDAEWKDAARILARAEAVTTPTKRAAEFLEQKTGLTRVYAVSCGINADEYTPSFEPRTSNRITFVGRVTGEKHIDVLVKAVAQLPDDLEATLEIVGDGDQLKNLEQLAEQLGIRDRVHFTGYVSDIELRQAYTRSTVLAMPSTAELQSIVTMEAMASALPIVAADAMALPHLVHDGENGYLFAPDDVHDLAAKLERVLRLPDDEFAAMKHESLKLIAAHDIQRTLNTFECLYRGEAVPDPVVDQSAPTTAD

SEQ ID NO: 8112 - protein, 365 aa, Unknown
  Description of Unknown: Chloroflexi bacterium sequence
MRVALIAPLVSTIAQPYPGGAQALLADLAQGLIRRGHTVTLFASDGSLVPGVSIEPVVVPESVRPANFSEPLQGRRADEGFFTQANLFLELFLQLQRRSADFDLVHVHAFDWPAFACSTLVQDIPVIHTIHLPAVSPEINAALRVLHRQGHPLTLITVSHACARTYGDYTPIDSVIYNGIDLDTIPFSPKASVEAPLLFAGRIAPEKGVEAAIDIAEKAGYRLLIAGGIYDRHYYEGRIVPKLRRAGERVTYLGHLDRLALWKIMGRSLGLLFPIEWDEPFGLAAVEAMAAGTPVIAYRRGAAEEIIGHGETGFLVEPGESAHAAALVDDLFDIPRVRCRAHVEAHFSLERMLDEYEAVYYDLAN

SEQ ID NO: 8113 - protein, 378 aa, Halanaeroarchaeum sulfurireducens
MSGRNSASTPPAVAAFTDTYLPTVNGVTYTISAWRDRWNTRGSRMDVVYPRSSYEPDDGEHPVTSVPFPFYDGYRLGLPQLPDAVRDVDVVHAHTPFLLGLSADRLARRESVPLVVSYHTPTAEYAEYLVPSWASSAVASLSRQYESWFLDRADLVLTPSAATASDVRRLTDAPVETHSNGVDVEFFRPTDSASFIRRHSIPDDRPIVGYTGRHGYEKNLDAIFEATADLDVTVVLAGDGPARESLEETAAALDVDAIFLGFLERENLPAFYSTLDVFAFPSPVETQGLVALEANACGTPVVAVDSGALSATVEDGITGYHFGPGDVAGFRNQIERALKNGDSLSQSCLDRRSEISLEMSMDRLEDTYERLLSSTDES

SEQ ID NO: 8114 - protein, 387 aa, Unknown
  Description of Unknown: Mycobacterium tuberculosis H37Rv sequence
MRVAMLTREYPPEVYGGAGVHVTELVAYLRRLCAVDVHCMGAPRPGAFAYRPDPRLGSANAALSTLSADLVMANAASAATVVHSHTWYTALAGHLAAILYDIPHVLTAHSLEPLRPWKKEQLGGGYQVSTWVEQTAVLAANAVIAVSSAMRNDMLRVYPSLDPNLVHVIRNGIDTETWYPAGPARTGSVLAELGVDPNRPMAVFVGRITRQKGVVHLVTAAHRFRSDVQLVLCAGAADTPEVADEVRVAVAELARNRTGVFWIQDRLTIGQLREILSAATVFVCPSVYEPLGIVNLEAMACATAVVASDVGGIPEVVADGITGSLVHYDADDATGYQARLAEAVNALVADPATAERYGHAGRQRCIQEFSWAYIAEQTLDIYRKVCA

SEQ ID NO: 8115 - protein, 403 aa, Rothia dentocariosa
MQQAKKILIGAETYPPDVNGAAQFGHRLATSMLKRGHEVHVVAANPSRGPSYRTVVEGGIVEHRLRSHLPPTHETNRICIPWEIHAEVGRILDEVKPDVIHVQCHYIIGRALLKQAHKRGIRVIATNHFMPANLDPFLPFPEPVKKVYAHITWADMRRLFKYAAVVTTPTQIGADAMRDLGRFTRPVMPVSNGIEISDYELAEGADLGKAPGELRVTFVGRLAEEKHVDVLIEALSLLPEDLDHVRLDIAGGGELRETLEQKARECGVENRVTFRGFVPDEELPGVYQRADIFCQPGTAELQSLVSLEAMSASTPVVLANALALPHLVEEGVNGYLFEPNNPQDLADKLTAILRLPAAEREQMGRESRRIVEFHSAENTWRTFEELYVSDAPYERFLAQRSEK

SEQ ID NO: 8116 - protein, 393 aa, Microterricola sp.
MGADTFAPDVNGAARFAERLAAGLVARGHEVHVMAPAASRKHGSWMEEHEGQKMMAHRLNSWRWYPHDWLRFALPWRIRQNSARVIDLVKPDVVHFQSHIIVGRGLSVEAEKRGIRIIGTNHFMPENLLEFTLLPKAWQEWAIGLAWKAARRTFGRAEAVTTPTAKAAQFLEQYTGLKGVHAISCGIDAHEYTPNFEPRTGNTVLFVGRVTGEKQIDVLLKAMTLLPAELDTKLHIVGGGDQMRNLQHLADSLGIGDRVTFRGYVTEAELRAEYTAATVFAMPSIAELQSIATMEAMASGLPIVAANAMALPHLVADGQNGFLFEPSNPTDLADKLRTVLEMAPAELTAMKQESLNRIVAHDIQRTISTFESLYRGEAVTDLVTNAAPAASSD

SEQ ID NO: 8117 - protein, 428 aa, Halomonas saccharevitans
MRLARGNALVLRRQAERGALQAWASSAQEAARPSSTDSHTLKILMISDVYFPRVNGVSTSITSFCAALKRLGHSVTLVCPAYPVGQTDTPGIWRISSRGVLGDPEDRMMHYRDVLALSSSQYAIHSFDLIHVHTPFVAHYAGITLGRRLDIPVVATYHTLFEEYLHHYVRWLPRPWLCFIARRLAVRQCHQLSAVIAPSRAMREALEHYGVTTPIAVIPTGLNLEAFTHPHEEHDFRTTYGLPPTARLLLYVGRAAHEKNIGFLIDMLPQVLAHHPNARLIITGEGPAQAALARRAREAGLEQFVHFLGYLDRDGPLQAAYRAADAFVFASRTETQGLVLLEALALGTPVISTAVMGTCDVLVDGQGCLIAEETHVDFAAKVNRILSDSTLREELVRRGPAHAARWHEDTQTAMLAKVYQRCVTLEVR

SEQ ID NO: 8118 - protein, 394 aa, Catenuloplanes japonicus
MRILIGAETYAPHVNGASYFAQRLADALTARHEVHVVSPSTGYRSFRRRAANGVVEHRVRALPVPTHPGFRFCAPIGLRQVAARILDEVLPDVVHVQSHFPLCRALVSEARARGLLVVATNHFMPENLTHYLPVGGGGRQVVHDWAWRDAARVFAAADAVTAPTPYAAALATMAGVPGPVLPLSCGIDLERFGPQVSASEFRLRHGVEDKPTVLYVGRLDAEKNLDVVIRAFALVREKADARLVLVGKGAERQNLEALAERLGVSGTVRFTGFVPDEELPSAYAAATVFVNAGTAELQSLVTLEAMAGGRPVIGADAAALPHLVIDDETGYLFPPGDSMALADRLLTVLGNPDLAESLGRSARAHAEKHDEAVTVAAFESLYAIRAARAAASVV

SEQ ID NO: 8119 - protein, 400 aa, Unknown
  Description of Unknown: Armatimonadetes bacterium CG_4_10_14_3_um_filter_59_10 sequence
MNIAFFSECYHPTLNGIVVSIDTFSQYLRRLGHRVHIHAPYYRGYHDDPPDVSRFPALRVPVVPQYPVPIPVGPRIAATFIHRRFDVVHTHSVFALSHVGASLAERTDVPLVSTFHTMLLDYLHYTFVPEQMTRPFVANLIRRYCNHCDLMIVPTAQVSDFLRKLGVVTEIQPLPTGIDVEFIRGGDRERVRKALGLPLDRKLLLYVGRLAREKNVTFLVDAVMHVLREHPGVDFAMVGEGPLKDDIREQVGASRLASRIHIVGGVSFEEVRDYYAAADIMTFASKTETQGLVVGEAMAAGLPVVAVRATGVSEFIASGEDGFLVDENPGAFVRTLSALLSSDSLRSSISTRARCKAQQFSAEASARRLEKFYQVLIASRKDFLQGSPGKRWGDHGSAAA

SEQ ID NO: 8120 - protein, 403 aa, Thermus tengchongensis
MRLYRVGLFTDVYFPNPNGVTTSVYLLLRELRRMGHEAWVIAPRHPEAPEGEEGVIRVPSVAYPFYEGQQIALPSARYLPTEFELIHTHTPLTLGVWGLRIARNKGLPHVSTFHTHYEKYAHYVPGLAILDKYTGIVPRLAKAFYNRVEVVIAPTEPVRRLAESYGIERPIRVIPTGIDNRLLEEAPLPSPSPWPEGKRRLITVGRLGKEKSFDVVLKAVAELAKKADVFLVHIGEGPELHALKHLAEALGIAERVRFLGPVPYGKIGGYYRMAELFLFASETETQGLVVWEAQAMGVPVVAVGAEGVLEGVEEGKTGYLVPPGDFQALAERALELLMDEEKRRRFSLQARAWALERSAERIAERIVAVYDEASEILRVEPKRLIFPFPRLPRSTLEDRPGGF

SEQ ID NO: 8121 - protein, 366 aa, Unknown
  Description of Unknown: Halobacteriales archaeon QS_8_65_32 sequence
MPGGPRVAAFTDTYLPTINGVTYTIRTWRDRWDERGGRMDVVYPGSAAYNAEGGEFSVPSLPFPFYDDFRLGAPAIPDAVRDCEIVHAHTPFGVGLGGLRLAWEAGCPLVASYHTPTAEYAGYLVEGWLRDVVARVGDAYERWFLERADRVVAPSESASEALRERGIGPVSVVPNGVDIDRFAPVDPSSFRARHDLPGGPLIGYTGRHGYEKRLADLVDAAAGLDVTLVLGGDGPAREAVKTRASQAGVDARFLGFLDRAELPEFYSALDVFAFPSPVETQGLVALEAIACGTPVVAVASGALVDTIEAGETGYHYAPRDTAGFKTALRRALADREALCEACLARRESVAVERAIDDLEAVYDAVR

SEQ ID NO: 8122 - protein, 407 aa, Nocardiopsis sp.
MTRTDRVLRVLIATDTYPPDVNGAGYFTHRLAEGLAGRGHRVHVICPSDHGDPYVAVNNGVTEHRLRSAPIPLQESMRMAVPLGIGGHTARLVARLDPDVVHVQSHFPVSRTALRRGRAAGVPVVFTNHFMPENLYAHAHLPQGAHTVAGSIAWRDMVRVAAAADHVTAPTPRAARLLREKGFARVVEAISCGIDLERFHPREGERATARARFGLPDRDTIVFVGRLDVEKRIDDTIRALARVAPEHDAQLVLAGTGQRERELRALAAELGIADRVSFLGFVPDEDLPLVFATGDVFAIAGVAELQSIATLEAMSSGLPVLAADAMALPHLVEEGRNGFLFPPGGVDVLADRLRTVLGPGDRRRAMGEASREMALRHDHHRSLERFESVYASLGAPAPLRLERVVAA

SEQ ID NO: 8123 - protein, 413 aa, Unknown
  Description of Unknown: Cryobacterium sp. MLB-32 sequence
MPGNTAPEVAPQAKKPIRVLIAADTFAPDVNGAAKFAERLASGLVSRGHEVQVMAPSATRKYGTWTEMHEGQPMTVHRLHSWRWYPHDWLRFALPWLVRRDSRRILDTFRPDVVHFQSHINVGRGVTIEAEKRGMRIIGTNHVMPENMLKFSLVPLGLQDRVIKAAWRAARRTFGRAEAVTTPTRRAAQFLEKYTGLTGVHAISCGIDADNYSPNFEPRTENRILFVGRVTGEKQIDVLLQAAALLKPELNAQIEIVGGGDQKRNLEHLAETLGLTPRITFTGYVTDEELREAYSRATVFAMPSIAELQSIATMEAMASGLPIVAADAMALPHLVHDEQNGFLFKPGNAQDLADKITRILELSPDSLEALKSESLNLIAAHDIRRTLNTFECLYRGEPVTDTVTNGASSHSSE

SEQ ID NO: 8124 - protein, 393 aa, Pseudonocardia dioxanivorans
MRPLRILIGADTFPPDVNGAARFAERLASGLAGRGHDVHVVAPSPDATAHREPARPGADGVRVHRVRSHRYPLHETFRVCLPWQASPATAALVADLAPDVVHVQAHFVVGRGTAVAASRAGVPLVATNHFMPENLFGHARVPAALQQAAARWAWRDLARVFSRASVVTAPTERAAGLLADAAGIDGVLPISCGIDSARYAGGVESPTPTVLFVGRLDEEKRVDELLRAVAALPTGLGARLEIVGDGSRRAAWTALAGELGLAERVMFHGFVDETTLVEAYRRCTVFAMPGIAELQSLVTLEAMSAGKPVVAADAMALPHLVRPGRNGWLYTPGDVEGLAAALGALLADPATRARMGAASREIVAGHALDATLDRFEEVYARAAGRVEMPVRAA

SEQ ID NO: 8125 - protein, 414 aa, Nocardiopsis sinuspersici
MAQFDRPLRVLIATDTYPPDVNGAGYFTHRLAEGLARRGHRVHVVCPSERGEPYVTVNGEVTEHRMPSAPIPFQPSMRAALPLGLGGHLARIVQRMDPDVVHAQSHFPVSRAALRKGRAAGIPVVLTNHFMPDNLYAHARVPAPMREAAGTLAWRDMIRVAGEADYVTTPTPRAARLLREKGFARTVEDISCGIDLERFRPRAGDRAAARRRFGLPDRDTIVFVGRLDEEKRIVDTIRALARIVPERDAQLALAGTGQREEELRALAAELGVADRVFFLGFVPDEDLPLVYAAGDAFAIAGVAELQSIATLEAMSTGLPVVAADAMALPHLVEEGRNGFLFPPGDDARLADRLLTVLGPERDRLAMGAASREIALRHDHRRSLERFEDTYRRLRGAPPVPLWVERAVAERAVAV

SEQ ID NO: 8126 - protein, 272 aa, Escherichia coli
MKLYTQIRKRAPQARVVIHMHNAFEPKLLEQNVKMIVPSLYLKKYYQSYLANADIEIVPNGIDLETYQSNFQPITRSELNISPEEKIIFYAGRIVPDKGILLLMQSFEKLAAAHKNLKLVVIGDYTEMSKSDKGAYQRNVREIAKRLKDRCIMLGSIPPEKMHCYYPLADLVVIPSQFQEPFCMVAIEAMGAGKPVLVSTRGGMTEFVKKNTTGFHLKEPMTADSISSDILKTLANPELTAVAKQGQDFVFEHYSWDGVTQRFEEVIHNWFE

SEQ ID NO: 8127 - protein, 394 aa, Unknown
  Description of Unknown: Candidatus Lumbricidophila eiseniae sequence
MGADTFPPDVNGAARFAERLASGLVARGHEVHIVAPASSRIYGTWTEIHGGEALTAHRLRSWRWYPHDWLRFALPWSIRRNSARILDEVRPDVVHFQSHIVVGRGLSVEAEQRGIRIVGTNHFMPENMLAFTLIPRAWQDFSVKLAWKAASRTFGRAAAVTTPTRRAAEFLERSTGLTGVYAISCGVDVPQYWPNWEARTENRVLFVGRVTGEKQIDVLLHATALLLRDSVDLTVEIVGDGDQKRHLENLAVTLGVADRVTFTGYVTDEELRAAYHRASVLAMPSIAELQSIVTMEAMASALPIVAANAMALPHLVHDGENGYLFEPGNAADLAAKLRKVLDAPPAEYRALKEESTRLIAAHDIQRTLSIFERLYRGSPMDDPPIDESSIASDA

SEQ ID NO: 8128 - protein, 437 aa, Nocardiopsis potens
MERAPRTSGPESRRTTGRDRRLRVLIGTDTYPPDVNGAGYFTHRLATGLAERGHDVHVVCASEEGAPGIAYDGEVTLHRLRSAPVLVHPTMRTAVPLGIAGHVARIMDRLAPHVVHAQSHFTVSRATVRQGRISGTPVVLTNHFMPDNLFAHAHIPERLQGLAGRLAWRDMVRVANEADYVTTPTRRAADLLAQKGYDRPVEAVSCGIDLERFHPRPAERAGARAGFGLPDRETMAFVGRLDEEKRIDELIRALPLVHRERDLQLVLAGTGQREAELRELAAGLGVADRVHFLGFVPDEELPRVYVAADLFAIGSVAELQSIATLEAMSTGLPVVAADALALPHLVDRGRNGYLYRPGDVAGLADRLLAVLGSGREAMGAASREIALTHDHRRSLARFEEIYTGVRPTRGGPQGPVPGRGGAAPGRPARPRRHPVPA

SEQ ID NO: 8129 - protein, 433 aa, Halomonas anticariensis
MFTNTYRPIVGGVSESVQRLKNRLQAEGHRVLVVAPKMRGQPRREKDVVRVAAVQHFNGSDFSLPVPIPGQLFEAIEDFDPDIIHSHHPFLLGDTAARAADTYGLPLVFTHHTLYEHYTHYVPGDSPRMQRFAVALSTEYTRLCEAVIAPSESIRDLLLRRGANVNITVAPSGVDTRRFGRGDGTMLRLRLGIPRGAYVVGHVGRLAKEKNLPFLAEAVARLLQWQRDAHFLVVGDGDARECMQQEARRYGVESRFHFTGRLQGQALIDAYHAMDVFAFASHSETQGMVLVEAMAAGLPVVAITAPGVREVLRDGSNGRLLMHDDSMGMTMALDDLADPERRRSMSVAAHGVAAMFDESRCAARCLEVYRRAIAVGGAFSHADDNTWERVRSRLGAEWHMLLHRGRVLRSLLQDEPSDRATGIDSEIHDTAPK

SEQ ID NO: 8130 - protein, 375 aa, Haloferax larsenii
MQSVAAFTDTYLPTVNGVTYTIQTWRERWHRRGGRMDVVFPRDDEYTPEPGEYGVRSLPFPFYEGLRIGAPRVPKAVEDADIVHAHTPFGLGLAGLRLARRKNIPLVATYHTPTAEYAEYLSSIGAIERGVERTAERYERWFFDRADAVIVPSEDAKRRLRHVLGVDSDVVVLSNGIDVEQFSPVAGDDFRERYDLGSGPLVGYTGRHGYEKELDELVRAAADLDATLVFGGDGPARDDLEALAADLDVDARFLGFLDREELPAFYSALDVFGFPSPVETQGLVALEANACGTPVVGVDAGALEDTVVDGRTGYHYEQGDTEGFSRAIRRALDERETLSSNCLDRRDEVSVEHSVDRLATLYDRLTANKKARRKR

SEQ ID NO: 8131 - protein, 428 aa, Unknown
  Description of Unknown: Verrucomicrobiae bacterium Tous-C4TDCM sequence
MKIAMFTNTYLPHVGGVARSVNTLEEACRARGHEVRVVAPEFDDAVPSPHVLRVPAIQHFNGSDFSVRLPVLNVVRDFMEDFKPDIIHSHHPFLLGDSALRESWKMRVPIVFTHHTLYERYTHYVPLDSPALKRVAVQLATEYCNLCDQVIAPSESMEHLLVERGVTRPILTIPTGIDTAFFAAGDGARFRDQVGIPRDAKVIGHTGRLAREKNLMFLAEAVAPCLAADPRAVFLVVGDGDARPELLEYLRKHAGEDQFHFTGSLSGPALADAYAAMDCFVFASQTETQGLVLAEAMATGMPVVALDGPGVREIVRDGENGLLLDGHASARDFSAALRRLMEDPELTLVCSRNARATAADYDTGRCVARVLECYTKLIADYPGRMEEDPTAWDRLLSGIEIEWSLLVGKMSAAAAAVSETPATEDLLD

SEQ ID NO: 8132 - protein, 393 aa, Unknown
  Description of Unknown: Cryobacterium sp. Hh39 sequence
MAADTFAPDVNGAARFAERLAAGLVARGHEVQIMAPAASRKHGSWMEMHEGQPMMVHRLHSWRWYPHDWLRFALPWIVRRESRLILDSFKPDVVHFQSHINVGRGVSIEAEERGIRMIGTNHFMPENMVKFSLIPLGFQDRVIKAAWRAARRTFGRAAAVTTPTLRAAQFLKKYTGLTEVHAVSCGIDADNYSPNFEPRTENRILFVGRVTGEKQIDVLLQAAALLAPSLKAQIEIVGGGDQKRNLEHLADTLGIRSRVTFTGYVTDAELRAAYSRATVFAMPSIAELQSIATMEAMASGLPVVAANAMALPHLVHDEQNGYLFAPGNAQDLADKLTTVLTADAANLEALKRESLKLIATHDIKRTLNTFECLYRGEPVALLVADDAATHATD

SEQ ID NO: 8133 - protein, 394 aa, Kocuria marina
MADPPTEHKALRILITAETYPPDINGSAQFARRLAHGMLERGHEVHVAAPMPTSGPSRIMDDAGVTEHRFRSHHAFTHPYFRLCFPWEIAREVARVFDDVRPDVVHVQCHYILGRLVVREAVRRGVRVVGTNHFIPENIEPFLPFPQWFVRGYRKVSWRDIARVYGRCDVITAPTPLAVRTMVDNGVPDRAIAVSNGIQAGDYEAAAGERIEHPDHPVVLFCGRLAVEKNVDELIEAVALIPRQKNVHAEIVGEGEQLDRLVNLAHERGVADRVHFLGFLTDEQLRTAYLRADVFCQPGTAELQSLVTLEAMSASTPVVLANARALPHLADEGRNGYLFSPGNPGDLATKLQLVLDAPPEQRRAMGERSRDMVSRHSFAKTLDTFESLYRGAAR

SEQ ID NO: 8134 - protein, 334 aa, Unknown
  Description of Unknown: Candidatus Rokubacteria bacterium sequence
SLKVVRYPSIPVTTYPEFALAVPYSRRIDRMVASLEFDVIHAHHPFLLGPAARRLARRTRRPLVFTYHTRYEKYAHYVPLPLGLVQAAALRLSAGFAAQADAVLAPSAVIRDELHARGVRTPIAVVPTGVDLELFRPGDRAAARRGLGVGEGEPLVLYVGRLDREKSVDRVLVAFERVASTVPAARLVLVGHGTEAERLRRLAGSLPVAQRIRFVGLRPHDSLAECYQAADVFLFASETETQGLVLAEAAACGLPAVAVDAPGCDEVVRDGDTGVLTKGDPTALAEAVIGLLLDPERRRAMARRARENAERLFDVRLQIDRTMAVYADAVARFR

SEQ ID NO: 8135 - protein, 640 aa, Desertihabitans brevis
MAVRRRVRCAGCAAARQRPAAGPGLGGATGGGDGGPTQRAADRPADPGAAAGEGVGGGGGHTAGCRRVRPADRRQRRQRGARLHPRARGQRRRRRPLPGARRRRHPGSRTLAHPAVGQRRRLRLRAGLGLRQGPLPHPRCRHAADLTAGVGHGPGDGAGLRAGGLDDPARLPRRVAGGRGRRADRDRPGGRRPDRSVPAGRGRLRAAGPGGDARLRTGRHRRCGRPLQPPPRGGQAPSARRVEPEHLVKILIAADTYAPQINGAARFTERLAEGLARRGHDVHVAAPSPDGRPARQRVRGITVHHVRSYRYPRYERFRLGGPWRTAAQPLVDELRPEVVHIQAHFTVGRAFAAAAVHRGIPVVGTNHLMIDNVFDHLPVPGFARGWVTRTVWRDIGRVFGQASVVTTPTPSAVQLLTEATGLQALAVSCGIDNHSFAEASGRWAPAKEAADWVPTVLFVGRLDPEKRVDELLRAFAQLPADVPARLEVVGHGSCGAQLRAMAERLGVTDRVTFHGVVTDEELVEAYGRADLFCMPGVAELQSIVTLEAMAAGRPVVAADAMALPHLVRPGRNGYLYTPGDVEELSGHLRRLLADPALRARMGRESETIVAGHTLDATLARFEDIYCQVTRGRIVRLRRAA

SEQ ID NO: 8136 - protein, 424 aa, Mesorhizobium sp.
MNILMLTNTFTPYIGGVANSVTWLAENLRAAGHRVLIIAPEFDGAPEDEIDVLRIPALQRFGGSDFSVPIPLSRSLDEALGVFQPDIVHSHHPFLLGDTALRVSATRDLPIVYTYHTRYELYGHYVAQDSPALKRLVLSLALGYCDLCDAVIAPSQSMAQFLTEHGVKTPVTVVPTGIDATRFDHGDGKRLRSASGIPSDAFVVGHVGRLAPEKNLEYLTEAVKQFLTSHAGAHFLVVGCGETMAHIQDTLTGAGLGSRVHLVGALTGTELADAYAAMDVFAFSSHSETQGLVLVEAMAAGIPVVALDAPGAREVVTDSRNGRLLPANSPADHFAHALHWVVGRSVAERKTLREAAIQTSKRFSNDATTKMALTLYASVLKAHRAARASKDNNWQAAKRGLGEEYKILRNLAHAIGEAVLTSAS

SEQ ID NO: 8137 - protein, 430 aa, Halomonas muralis
MFTNTYRPIVGGVSESVQRLKSRLQAEGHRVLVVAPKMKGQPRHEPDVVRVAAMQRFNGSDFSLPVPIPGRLYEVIEEFDPDIIHSHHPFLLGDTAARAAETYGLPLIFTHHTLYEHYTHYVPGDSPRMQRFAVALPTEYTRLCDAVIAPSESIRDLMRQRGANDSVHVVPSGVDTRRFSRGDGTRLRAQLGIARGDYVVGHVGRLALEKNLPFLAEAVTRLLRRQPDAHFLVVGDGGARDAMQAVAIHAGVAERVHFTGKLHEQALIDAYHAMDVFAFASHSETQGMVLVEAMATGLPVVAVNASGVREVLANGNNGLLLPNDDAETFADMLASLNDAQRRAVLRDGALATAANFDETRCTARCIAVYRRAIAAGGPFSHADDGAWERVRSRLGAEWQLLRHRGRILRWVFQDEPVISFETNESKAPQK

SEQ ID NO: 8138 - protein, 419 aa, Kocuria sp.
MLPPVDVDDRPVPDGGALTVLVVAETYPPDVNGSSQFSRRLAQAMAGRGHRVHVAAPRPGRGHSIRRMDGHVTEHRFRSHTAFTYTTFNFCFPWEIRGEVNRLLDEVQPDVVHVECHYILGRFMATEARKRGIRLIGTNHFIPENIEQYLPLPSLIRRMYRRISWRDMAGVFRNCDVVTAPTPLAVESMKRHGFDFPVYALSNGIQAENYELREGEAPPHSDRPTILFVGRLDPEKHVDVLIKALARIKDDTDAVLEVVGQGGEFEKLAGLAEQLGLGDRVRFRGFVSDEDLRLAYLGADIFSQPGTAELQSLVTLEAMAASCPVLLANARALPHLVDPGVNGWLFTPGDDAEVADKLLAFLHLPEDRRRDMGLASHKLVEEHSFDATVEAFERMYRGADPERLLANWPMLEPLETPLG

SEQ ID NO: 8139 - protein, 381 aa, Unknown
  Description of Unknown: Hydrogenophilales bacterium CG_4_10_14_0_8_um_filter_62_70 sequence
MTLRILTVSDVYFPRVNGVSTSIETFRQVLTEHGVTMQLVVPRYGDEVEQAGIVRVGARTLPRDPEDRLLAWGETRRTVLSEAMDCDLIHIQTPFVAHYAGLKAARRLAKPVLATYHTLFEKYLSHYAPFLPEEWLRGAARRFSRTQCNDLDTVIVPSTAMRDRLTEYGVTVPIHILPTGIPLSRFAQGDRARFRELHRIPETQPVALFVGRVAHEKNIAFLIDAVAEACRTVPELLFLITGEGPAEKALRRQAETLGIAAKVRFLGYMDRQHELPDCYAAADVFIFASRTETQGLVLLEAMAMGLPVVALAAMGTKDILGPGRGSIAPPDDVTEFAAAINRMIQDQVLRQRLSVEAREYALEWADDRMAGRLAALYRSLS

SEQ ID NO: 8140 - protein, 368 aa, Halorussus sp.
MHRVAAFTDTYLPTVNGVTYTIASWRDRWERAGGRMDVVYPNADGHRPNDGEHPVGSLPFPFYDGFRLGTPKIPKAVRSAEVVHAHTPFAIGLGGLRLARDRDLPLVASYHTPTAEYAEYVSPTDAVASLVERVSEAYERWFFGRADAVLVPSTATRDHLRDAVGVETRVEVVPNGVDTERFRPVETEKFLARYDLDGDRPLIGYTGRHGYEKRLPELVAAASEMDVTVVFGGDGPAREDLREQAESLGADARFLGFLDREELPAFYSALDAFAFPSPVETQGLVALEANACGTPVVGANAGALADTIEDGETGYHYESGNITDFQDAIDRTLDEREQLRETCLVRRDAVSVDHAVEKLRSVYESLRS

SEQ ID NO: 8141 - protein, 394 aa, Pseudoglutamicibacter cumminsii
MTQETPLRILIACDTYPPDVNGAAVFCYRLATNLTKRGHEVHILAVRNDRGPSFVEHRPEATVHRVTSHKAPTHETYRLVTPYSANKVAGRVMDEIKPDVVHIQCHYMIGHAAQKQATKRGIRLIATNHFIPENLEPFLPFPQWFLNIVSRNSWRDMGKIMGKAAVVTTPTPLAARAMRENAGLTDVLPLSNGINSAHYEMRENETLPQRDYQTVLFVGRLAVEKNIDVLLRAIARLNQHPRPHVRIVGEGEQRPKLEALAAELGIEDRVHFLGFVDDETLRQEYLCADVFCQPGTAELQSLVTLEALSASRPVVLANALALPHLVDEGVNGHLFTPGDDQDLAEKLASILDLSPAERKAMGEAGHQMALKHGEEKTIKTFEALYRGADVHDYL

SEQ ID NO: 8142 - protein, 367 aa, Halorussus salinus
MERVAAFTDTYLPTVNGVTYTIASWRERWERAGGRMDVVYPNADGHRPNDGEHPVGSLPLPFYDGFHVGTPKVPKAVRDAEVVHAHTPFNIGVGGLRLARKKDVPLVASYHTPTSEYAEYVSPTDSIASLVGRVSEAYERWFYGRADAVLAPSEATRDHLKSAVGVDTPVEVVPNGIDTERFRPVETDEFLARHDLRGERPLIGYTGRHGYEKRLSELVAAAADMDVTVVFGGDGPAREDLEEQAESLGADARFLGFLDREEMPAFYSALDAFAFPSPVETQGLVALEANACGTPVVGANAGALADTIDHGETGYHYESGNIDDFRDAVHRTLADRDDLRERCLARRDEVSVEHAVEKLHDVYDRMR

SEQ ID NO: 8143 - protein, 399 aa, Nocardiopsis sp.
MTERPLRVLIASDTYPPDVNGAGYFTHRLAEGLAGRGHRVHVVCPSERGEPHVTVNGAVVEHRLRSAPIPFMRAAVPLGMGGHIARIVERLDPDVVHAQSHFPLSRAAMRRGRAAGVPVVLTNHFMPDNLYAHARIPAPMQELAGLLAWRDMVRVAGEADHVTTPTPRAARLLREKGFTRGVEAISCGIDLERFRPHEDPAAARRRFGLPDRDTIVFVGRLDAEKRIDDTIRALARIVPGRDAQLALAGTGQRGEELRALAAELGVADRVFFLGFVPDEDLPLVYGAGDAFAIAGVAELQSIATLEAMSTGLPVVAADAMALPHLVEEGRNGFLFPPGDPALLADRLLLVLGPRGRALGAASRELARRHDHHRSLERFEEVYTRLRGTAPARGERPVAA

SEQ ID NO: 8144 - protein, 367 aa, Natronococcus amylolyticus
MVETVAAFTDLYLPTVNGITYTISLWRERWSGRRASMDVVFPKIDGYEPNDGEYAVPSIEAPLYPRYRLGRPTPPDDLDVPDVVHVHTPFSLGVAGVRFARANDVPLVASYHTILEGRVPDLVSNSLVEPGRRLCRAYERAFFARVDHVIVPTAFARRHLRESVGADVEATVVSNGIDTDRFRPTDPGPFRERYGLPDGPLLGYTGRHGPEKNLEEAIDAVAGTDCTLVLAGDGPAREGLERRAAETGADARFLGFLDREELPAFYSALDAFVFPSPVETQGLVALEATACGTPVVAADAGALIDSVIEGETGYRYEPGDLEAFRWAIRRTLAENDRLSDLCRRRRAMLSVEHSLEQLARVYGGLQG

SEQ ID NO: 8145 - protein, 380 aa, Auraticoccus monumenti
MNGAARFTERLAEGLARRGHDVHVAAPSLTGRPSRQVVRGVTLHHVRSFRYPLYERFRLGAPWRGAALPLVDELQPDVVHIQAHFTVGRAFAAAASHRGIPVVGTNHVMIDNIFDHLPVPRLARGWVSRTVWRDIGRVYGQASVVTTPTPRAVDLLTEATGLQALAVSCGIDAAPFKDASRRWAAASQAPDHVPTALFVGRLDPEKRVDELLRAFAQLPASLPARLEIIGHGSCRPELDAIAKELQVGSRVVFRGVVTDEELVEAYGRADVFCMPGVAELQSIVTLEAMAAGRPVVAADAMALPHLVEPGRNGWLYTPGDVEELAGHLATLLGDRALRRRMGRESEVIVARHTLEATLERFEEIYDEVTHGRIVRLRPAA

SEQ ID NO: 8146 - protein, 729 aa, Unknown
  Description of Unknown: Nitrospirae bacterium sequence
MKISVSMITLNEAQHIKRALSSCTFADEIVVVDGGSTDGTIEILESFDKVKLIKHPWEGHFGKQRQISLEHCTGDWVVRLDADEVFSEEFENGIRGLLESTPPDTLGYRVRQCNLIGDENYYSKTFDQYEASPRIWRNLKEIRWEKHIHEVLVFEGLTGNIDTWDVYVIHYGFLDRKKYWEKGKFYSNIKESGFGCPEELYYREYDIQPRPSRARVSSHVPPFVMEGEKRGLPRIAIIRGPNLNPWEMQNYEPLVGQFDITAYTTTKPNFDIDKIKLPVVKVPSHPEIPAYMMGLEFALFDSDLIYSADTTWPFSYQAVLIKEKFNKPLICLQWENIPFAYEENEQMRLMKKKVREGADFFIAVTERAREALLLEGVSPEKIIVLPMGININRFRPDRTTGLEVRNEFGIRPSEKVVLFVGRAVWEKGIYDLIYAIKLTEGYLKDAEIRAVITGRGPELETVKERVRELGIFDRFIFIESYPYHKIHKLFNMADIFVLPSISLRSWKEQFGMVLIEAMACGTPVISTLSGSIPEVVGDAGLLVQSNDPHSLADAIIDLIKNDDKRLELGKKGRERVESNFSSEKISQKFGDLFRYILNEYRKSKGRSITMENLGSDDNNGYYKQERRDVEALIPGDAKYILDIGCGEGLLGKRLLERGAKEVVGVELREDICKRAEKNLSRVICGNIEELELPFENGYFDCIILADILEHLREPGLTLKKLKGYLSQDG

SEQ ID NO: 8147 - protein, 439 aa, Halomonas sp.
MSQRRPRTLSDAEITALTHLANGNALYRQREAERKARLSSALALFHPAAPAVETPSLGLKILMISDVYFPRINGVSTSIASFRGSLERLGYSVTLICPDYLVGQVDEPSVLRIPSRQVPGDPEDRMMRYRDILALAPTLAGEAFDLIHVHTPFTAHYAGVALGRRLNIPVVATYHTLFEEYIHHYIRWVPRRWLRFAARRLSTHQCQQLDALVAPSQAMQHALSRYGVTTPTTVIATGLALESFCKPQDTNDFRSYYGLPQQARLLLYVGRAAFEKNIDFLIDMLPKVLTEHPTTRLIIAGEGPAHDSLVQRAQEVGVAESVLFIGYLDRSGPLQAAYRAADVFVFASRTETQGLVLLEAMALGTPVVSTAMMGTRDVLKEGEGCLIAGDHHEDFAAKVNHLLSDETRRQQLAKRAQTYAASWHEDTKSAELVAMYQKL

SEQ ID NO: 8148 - protein, 365 aa, Halarchaeum sp.
MQPRVAAFTDTYLPTVNGATYTVRTWRERWQARGGRMDVVYPDADYEPDPGEHPVASLDFPFYEGYRLALPHTPRGVVTPDVVHAHSPFAVGLAGYRYARRQDAPFVVSYHTPTSEYVEYLAPDALVAPLERASERWERFFLDRADLVLAPSERTCAHVRDLGVTTSVEALSNGVDVEFFAPTESAGFRERHGLGDGPLVGYTGRHGYEKRLRDLVDAVAGLDATLVVGGDGPARDDLEARARERDVDARFLGFLDREELPAFYSALDVFAFPSPVETEGLVALEANACGTPVVGADAGALVETVDDGETGYHYPVGDVDAFRDAIRRALDERASLSEACVARREEVSVSRAIDRLEAAYARVLD

SEQ ID NO: 8149 - protein, 464 aa, Unknown
  Description of Unknown: Candidatus Rokubacteria bacterium sequence
MTPSTRSTRGPRTRSRWRCASARRSTSTRTSSARPRASRCPRRPSRRRPTIRSSSGSGCRTSSRRTSRSSTRPERAGPVRVALFTNNYLPFCGGVPTSVETLRAGLEAAGHEAWVFGPRFATGAEAAPRVVRYPSIPAATYPEFALAVPYSRRAARLVAALDVDVFHAHHPFLLGPAARRLARRHGRPLVFTYHTRYEKYAHYVPLRRQFVETLAVRLSTRFAARADAVIAPSAVIRDELSTRGVASPIAVVPTGLDLERFRPADRRAARARLPVPADAPLVLYVGRLDPEKSVDRILLAFERVASTVSAAHLILVGHGTAAHRLQRLAGTLAASDRVRFVGVRAHAELAQYYQAADVFLFASETETQGLVLAEAAACGLPAVAVSAPGCEEVVRDGETGVLTKGDPMALGDAVIGLLLDAERRAVMSLRARQTAERLFDVRLMIERTLAVYAAATARVTHPVP

SEQ ID NO: 8150 - protein, 394 aa, Unknown
  Description of Unknown: Micrococcales sequence
MNSRPLKILIGADTYPPDINGAAQFGHRLAVGMRDRGHEVHVIAGRSSDGPSYDIEIDGIHEHRLRSHNPPTHPYYRLCFPWEMQRRVGKILDEVQPDVVHIQCHYIIGRMISWACKRRGIRLVSTNHFMPENLNPFLPFPDIALKVIAYCSWKDMGRVLGRADYVTTPTPIGAQAMHDHGFGAPVIPVSNGIDAARYELAPGEEVKKRDHPVVFFAGRLAVEKNIDVLIRAVALLPADLKVHLELAGTGEIEDELKRVAREAGVEDRVHFLGFVSDAELREGYLRADVFCQPGTAELQSLVSLEAMSASRPVVLANALALPHLVREGENGYLFEPGDPQDLSEKLTAVLTASDEERRRMGEVSHEIVQKHSVEKTWDAFEAMYRGEYRGPEGR

SEQ ID NO: 8151 - protein, 418 aa, Unknown
  Description of Unknown: Microbacterium sp. Leaf436 sequence
MTTSATPADHPVSDDAHDPAVSRETPAPAERPLTVLIGADTFLPHVNGAARFAERLAAGLVARGHDVHVAAPSIGRGHAGTATEVIEGQPMTLHRLPSYRFLPHDWLTFVWPWRAKHYARLMLDQIRPDVVHIQSHIIIGRGLAREARKRGIPVIATNHVMPENILDFTTLPDFLDRIMLKLAWADAKRTFVMTRAVTTPTRRAADFLQATIGIEGVIPISCGIDRSNYTPDLEPRDANRILFVGRLTTEKGIDVILRAMTKIDPALDVTFDIVGGGDQRRNLEQLAEQLGLAHRVTFHGHTSEEELRALYSRASVFAIASIAELQSIATMEAMASGLPIVAANAVALPHLVHDGENGYLFEPGNADELAARLTDVLTAAPDERRRMQQASLDGVIVHDIGRTLDTFEALYRGRPLPE

SEQ ID NO: 8152 - protein, 425 aa, Unknown
  Description of Unknown: Acidipropionibacterium virtanenii sequence
MRILIGTDTYPPTVNGAAQFTRRLAHGLAARGHQIHLACPSPTGAPGRMIDEAGVVVHRFRSFRYAGYQDFPVALPAGLRATAGQLLDDAGPDAVHVQSGFFLGRALLVEARRRGIGIVATNHLMPANVLDHLPCPQALRPAMATALWRDLRRVYLQADAVTSPTRRAVDLMYANTGIDGLAVSNGIDLDRYRRIPRVMSGGPVVLFVGRLDPEKHLEDAITAMALLPDDVPGRLEIVGAGSARAGWERLAGDLDLDPDRVRFLGKLPDDELLEAYGRASVFAMPGTAELQSLVTLEAMATGMPVVAADAMALPHLVHDGENGFLYRPGDATALAGRLATLLGDAGLRHRMAEEGRRIVAPHGIEHTLDTFEGLYRQVRRLTPLSSRTTGRQPAGRVADRQASDRPSRPAAMAELIAMPPAVSAR

SEQ ID NO: 8153 - protein, 453 aa, Halomonas subterranea
MPQRRRPPLNAPLSDQDVAALTHLANGNALYLQREADRKARQESALALLHSTTSTANAQPGCMKVLMISDVYFPRVNGVSTSIASFRGALERLGHSVTLICPDYPLGQLDEPGVLRIRSHRVPGDPEDRMMRYRDLLALTPQLAGKAFDLIHVHTPFTAHYAGVALGRRLGLPVVATYHTLFEAYVQHYIRWFPRRWLRLAARRLSAHQCHQLSALVAPSQAMQHALTRYGVTTPTTVIATGLALEAFCSPQLGSDFRAHYHLPREARLLLYVGRTAFEKNIDFLIDMLPKVLAEHPTTRLIITGEGPAQDSLVRRAQALGVAESVLFLGYLDRSGPLQAAYRAADVFVFASRTETQGLVLLEAMALGTPVVSTATMGTLDVLKEGEGCLIAEENHSDFATKVNQLLSDETRRAQLAERGQTYAASWHEDAKSAELVALYRKLAAERLANARK

SEQ ID NO: 8154 - protein, 382 aa, Unknown
  Description of Unknown: Microbacterium sequence
MGCDTFFPDVNGAARFSERLAAGLVQRGHDVHVVAPNQAYRRKAPGIEIIEGEPMTVHRLPSVRWPPHDWLRFVWPWRTKHYARQVLDAVKPDVVHIQSHIVIGRGLTREAAKRGIPVVATNHVMPENILDHTTLPAWMDALLVKWAWADANRTFQMTSAVTTPTRNAANFLEAAINITGVVPISCGIAASNYRPDLTPRDRNRVLFVGRLTREKQIDLLLEAIVTLDPALDVQVDIVGGGDQRKHLEQLAERLGLADRVTFHGRVEEEELRALYSRASVFAMPSVAELQSIATMEAMASGLPVVAADAMALPHLVHDGENGYLFDPASAADLAAKLTTVLTAAPDERRRMQEASLEGVRIHDIDRTLRTFESLYRGQPVED

SEQ ID NO: 8155 - protein, 393 aa, Agromyces sp.
MGADTFAPDVNGAARFAERLAAGLAERGHDVHVMAPAANRKHGSWTEIHEGQAITAHRLRSWRWYPHDWLRFALPWRIRQNSAKVIDRVKPDVVHFQSHIIVGRGLSVEAEKRGIRIVGTNHFMPENMLEFTLLPKAWQDWAVGLAWKAAGRTFGRAESVTTPTLRAAQFLEKHTGLTGVHAISCGIDAHKYSPNWEPRTENRIVFVGRVTGEKQIDVLLRAAALLPAELDAKIEIVGDGDQKRNLEHLAAQLGIADRVTFTGYVTDEQLRDAYHRASVLAMPSIAELQSIVTMEAMASALPVVAANAMALPHLVHDGENGYLFEPSSPEDLAAKLRTVLEASPDHYRALKEGSIRLIAAHDIQRTITTFEALYRGKPVADPVTDGATAALPE

SEQ ID NO: 8156 - protein, 429 aa, Allosalinactinospora lopnorensis
MSVTIPSAPSSGARARTATPSRAGSACLRVLIGTDTYPPDVNGASFFTARLAAGLAERGSDVHLLCPAPDGRPRAVRHGDVLEHRLRSVPSLVHDTVRLAVPLGVPGHVDRLLARLRPDVVHLQNHFVVGRLLLRAARRHGVPVVATNHFMPENMFNYLHVPVPLRNRIGRLAWRDFARVLAETDHVTTPTRTAAQLLVDQGLQRPVEAVSCGIDTYRFRPMWEEADGSILTSRARFRAHFGVPDRPTFAFVGRLDEEKHIEDLVSAVARITVDGAQLLLAGTGAQRRRLERLAADEGVADRVHFLGFVSDDDLPLVYRAADVFAIAGTAELQSIATLEALASGLPVVAADAMALPHLIEEGHNGYLYRPGDIDGLAARLSRLLASPEERAEMGAAGRAIASRHRYQRSLVRFEQIYHDLTGSPTASTG

SEQ ID NO: 8157 - protein, 414 aa, Rathayibacter iranicus
MSDSRDEFPSESPDSRPLTVVIGCDTFAPNVNGAAKFAERLAAGLAQRGHEVHVVAPSADGWSGTRVETHEGQRIILHRLYSWRWFPHDWLRFAMPWRIRQNSARILDEVKPDAVHFQSHIIVGRGLGIEAAKRGIRIVGTNHFMPENMLEFTLLPKAVQAKAVQMAWRAARRTFGRAEAVTTPTRKAAQFLEKYTGLQGVRAISCGINADNYTPDFTPRSRNSILFVGRVTGEKHIHVLLRAVALLDPSLDVTLEIVGGGDQMRNLQQLASTLGIAERVRFTGYVSDSELKEAYTRASVFAMPSIAELQSIATMEAMASALPVVAADAMALPHLVHDGENGYLFEPGSAEALAERLTTALTLAPEAFEAMKRASLRIVAAHDINRTISTFESLYRGEPVADPVAVVASARAAS

SEQ ID NO: 8158 - protein, 381 aa, Pseudonocardia oroxyli
MRILLGADTFAPYVNGAARFAERLAAGLAGRGHEVHVAAPSPTGAAGVGRFGDVAVHRVRSHRYPWHESFRVCLPWEAGPATAEILRRVRPDVVHVQAHFVVGRGLAAAAAASATPLVATNHFMPENLFAHARVPRFLRSAAARWAWRDVRAVFGRADAVTAPTPRAVALLTGATGLAASAVSCGIDAARYAGGDERPDTVLFVGRLDQEKRVDELLRAVARVPGARLEVVGDGTERGAWHRLAAELGIADRVVWHGFVSEEDLVAAYRRCAVFCMPGIAELQSLVTLEAMAAGKPVVAADAMALPHLVRPGRNGWLFAPGDVEALAVRLAALLADAGTRRRMGTASREIVAGHTLDATLDAFEDLYVRVAHVPSAGPVAA

SEQ ID NO: 8159 - protein, 411 aa, Nocardiopsis ganjiahuensis
MAQPNRSLSVLIASDTYPPDVNGAGYFTHRLAEGLAERGHRVHVVCPSEQGDPYVTAGGRVTEHRLRSAPIPFQPSMRAALPLGMGGHIARLVRRLDPDVVHTQSHFTLSRSALRRARTAGIPVVLTNHFMPDNLYAHARVPRSMQRAAGSLAWRDMIRVAAEADHVTTPTPRAAELLRDQGFAREIEAISCGIDLERFYPRARDRAAARARFGLPERDTLVFVGRLDEEKRIDVTIRALARIVPERDAQLALAGTGQREGELRALAAELGVADRVFFLGFVPDEDLPLVYAAADAFAIAGVAELQSIATLEAMSTGLPVVAADAMALPHLVAEGRNGFLFPAGSSVLMADRLLAVLGPDRERAALGRASRELALEHDHHRSLERFEAVYTRVMGRGRGRVRPEAERVMVA

SEQ ID NO: 8160 - protein, 399 aa, Ornithinimicrobium pekingense
MSRPGARRRAVRPRRVLLLSDCYRPTVNGVVTSIDELRKGLIEAGHDVRVLTVGPVRRTTFDGSVYRLPSVDARHIYPQARLGRPVDAETFADLVAWRPDVLHSHTEFVAFWWARRLAHRLGAPHVHTYHTLYADYTHYFFPHQRTGRALCAGFARQTLNRTTTVIAPTAKVEQLLRGYDVRVPIAVVPTGVDLSRFTPGPPSQTLRDSLGLTPGIPVILSLGRLAAEKSVTEVVDLLARVRDEPWQLVVAGDGPQAGTLRQQVERLGLNDRVRFVGAVDPAHVPDYYRLADVFVSASRSETQGLTFLEALASGVPVICRDDGSLDGVVLDGYNGRRYREPEEFVAAMTWLLRDPALRRRWSSGAVQTASGFGRAAFVDAVCATYDRARGCVGTARWAA

SEQ ID NO: 8161 - protein, 409 aa, Nocardiopsis sp.
MVQSNRPLRVLIASDTYPPDVNGAGYFTYRLAEGLADRGHRVHVVCPSEHGDPHVTVNGKVTEHRLRSAPIPFQPSMRAAVPLGMGGHISRLLWRMDPDVVHAQSHFTLSRSALRRGRAAGIPVVLTNHFMPDNLYAHAHVPRPMQRAAGSLAWRDMVRVAAEADHVTTPTPRAAELLRERGFAREIEAISCGIDLDRFHPRARDRAAARDRFGLPERDTVVFVGRLDEEKRIDDTIRALALTVPERDAQLVLAGTGQCEGELRALAAQLGVADWVYFLGFVPDEELPLVYAAGDVFAIASVAELQSIATLEAMSTGLPVVAADAMALPHLVEEGRNGFLFPPGNHVHLADRLLSVLGSKRRRQEMGRASREIAQEHDHHRSLERFEAVYRGLQGRGLGDPRSERVMVA

SEQ ID NO: 8162 - protein, 441 aa, Unknown
  Description of Unknown: Brevibacterium sp. Mu109 sequence
MRWPPRSAAPTASTAPLWAPETTTRCPILLADDPTPPSPGAHREDRPLRIVIAAETYPPEINGAGAFANRLATGLAANGHEVHVIAPSASGIPSHDWEEGVRVHRIVSHHWPLHPTWMICMPWETGPAVAQLLDDIRPDVLHTQAHFVIGRFAITHARRRGIPVVATNHFMPDNVRPYVRAPRRVLDTAARLAWWDLRSRFQRADHITVPTQLASDLLTENGFDRPIEAVSCGIDLARFDGADPAPEAASTTAPAVLFVGRLSQEKRPQDIVEALAAMDPALGLEARIVGAGDQEEVLPQLARDLGVGDRVKVLGKISDAQLDEEYRRATVFCMPSTAELQSIATLEALASGLPVVLADAVALPHLVRDGENGGLFRPRDAQDLARVLTRVVSASDQERRAMGAVSQEIAAHHDIRRTLARYEEIYRSVSAGSPEAPSLQG

SEQ ID NO: 8163 - protein, 419 aa, Catenuloplanes japonicus
MRILIGADTYAPHVNGASYFAQRLAAALNVHHEVHVVSPATGYRSRTRTTEGGIVEHRIRSLPIWQRRDFRFSLPVGLHAAAGRILDEVRPDVVHVQSHFPICRALIAAAYARGIFVVATNHFMPENLTHYLPLARDLVHDWAWRDAARVFAKANVVTAPTPYAAALAMVAGVPGPVLPISCGIDLTRFSTRGDAAGFRARHDLKDTPTIGYVGRLDAEKNLDVLVRAFAVVRRMTDSQLLLVGTGARERALRALAAELGVADDVRFAGFVPDDELPDAYAACTVFVNPGTAELQSLVTLEAMACGRPVVGANSAALPHLIVDGETGCLFPPGDVRALVRRLLSILDDPAHADALGRNARAVAEQHDESRTVAAFAQLYGIARVPAGPARQPGPVLLNGGDRNGHARGTGRADTGRRAA

SEQ ID NO: 8164 - protein, 402 aa, Streptosporangium canum
MVMSAAPALAPAPLATRPRRVLIGTDTYPPDVNGAAYFTHRLAGGLAERGNEVHVVCASEEGAARTEHVNGVTVHRLRSAPVLVHPTMRISVPTRLDRLMAAIAPDVVHVQGHFVVGRAAISAARRAGVPVVATNHFMPDNLFQFAHIPGPLRERAGDLAWRDFRRVFSRADRVTTPTRIAAGLLTGKGFARSVEPVSCGIDLSRFQPHAEPKAWARGAFGLPDRDTVLFVGRLDEEKRLDELVRALPYILNGTDAQLALVGTGGQRAALERLAARIGVGDRVFFLGFVPDEALAQAYAAADVFAMPGVAELQSIATLEAMATGLPVVAADAMALPHLVRPGENGRLFRPGDVQGLARHLNDLLCSPGLRGAMGAASRAIALTHDHQASLARFEAIYQEVTR

SEQ ID NO: 8165 - protein, 371 aa, Unknown
  Description of Unknown: Candidatus Rokubacteria bacterium sequence
MLGGVTRAVETIRASLEALGHSVLVVAPRMAGALPQPGVLRVPAVPAPTYPDFALPLPVGPRLTRALRALDLDVFHAHHPFLLGGTAGRLARSLGRPLVFTYHTLYDKYAHYVPLPRAAVARQALAWSTRFANQADVVIAPSEALAERIRSQGVARPVEVVPTGIDLGWFQPGNRTDARAALGLAPDRPLLVYVGRLDREKNLDFLLEAFAAVLRVRPDAELLLVGRGTRELSLRATTARLGVAHRVRFVGGVPPADVVAFYQAADVFVFASTTETQGLAVLEAMAVGRPVVAVRASGVEEAVMDGVTGLLTAEDSSAFAAAVTEILEDAGLAAKLAGGGREVARRFAAPVLAARLVGIYRRLLGADSVPD

SEQ ID NO: 8166 - protein, 407 aa, Azoarcus sp.
MNILMVSDVYFPRVNGVSTSIETFRRSLHQQGVRSTLIAPAYPGGGADDDGVLRIPSRFVPLDPEDRMMRSGHIAARADELAGEGFDLIHIHTPFVAHYAGLALARKLRLPCVATYHTFFEEYLFHYVPTLPRSWLRALARRFSRTQCNALHAVIVPSRAMAAALLDYGVERPLEILPTGIPPDQFQGGDGRFFRSRYEIPADARLLLFVGRVAHEKNIGFLIEMIDHLRHTEPRALLLITGEGPALATLRNAVAQRGLERHVRFLGYLDRHSELHDCYRAADLFVFASRTETQGLVLLEAMALGTPVVALAQMGTCDILEGETGCRIGPDDPAAFAALVASLLSRPELLERLAEEARQRARHWHADDIAARLVRLYARWIDASGSPRRVPELTAGSAGRRRLTSRS

SEQ ID NO: 8167 - protein, 391 aa, Unknown
  Description of Unknown: Microbacterium ginsengisoli sequence
MSDRPLTILIGCDTFSPDVNGAARFAERLAAGLVARGHDVHVMAPSITHRDHGPRVEVIEGENVTVHRLPSWRWYPHDWLRFVWPWLAKHYARQVLDAVKPDVVHIQSHIVIGRGLARIASQRGIPVIATNHVMAENILDFTTLPPLLDRLFVKLAWDDARRTFDLARAVTTPTKRAADFLVAAIDLQGVIPISCGIDAGNYTADLEPRTENRVLFVGRLTREKQIDLLFKAVALLDPALDVHVDIVGGGDQRKQLELVAHEQGLDGRVHFYGRVDDDELRRIYTRASVFAMPSIAELQSIATMEAMASGLPVVAADAMALPHLVHDGENGYLFDPTSAEDFAAKLTTVLTADAAERRRLQQASLDGVKVHDIQRTLSTFEKLYRGEPVEA

SEQ ID NO: 8168 - protein, 399 aa, Arthrobacter sp.
MSYPADTKPLTVLIAADTYPPNINGAAQFGYRLAKGMAARGHNVHVLAPNPANGRSYTEEPAGAWTVHRLRSHSVPTHDYWRICLPWEIKRDISMLFDRVNPDVVHIQCHYMVGEYTLYEAVKRGIRVVATNHFMPENLNPFLPFPEWFKRIVAKNSWRDMGRVMGKADAVTTPTPLAAKAMHDHAFLRQVLPISNGIDSAAYEPRPGEQLPPREHPTVLFVGRLAEEKHVDVLIDAVAKTPAELDVHLEVIGGGEVKHALQAQAARLGISDRVRFLGLVSDEELRLAYLRADIFCQPGTAELQSLVTLEAMSASTPVLLANAMALPHLVADGENGYLFTPHDSDELGRRITELVTLPDADRERMGKASRSLVEKHSLETTLETFERLYYGLSVEVELA

SEQ ID NO: 8169 - protein, 408 aa, Nocardiopsis sp.
MTTDRVLRILIATDTYPPDVNGAGYFTHRLAEGLAQRGHRVHVLCPSERGEPYVTVNGGVTEHRVRSGRIPVHDAMRFALPLGLSGHADRLVSRLDPDVVHVQGHFTVSRAAIGRARAARIPVVLTNHFMPDNLYGYVRLPEVLHQATGALAWRDMVRIAAMADHVTTPTPRAARLLLEKGFARQVEDISCGIDLERFHPRPEERTALRAEFGLPDRDTIAFVGRLDVEKRIDDTMRALARIVPERDAQLALAGTGQREQELRDLAAELGIADRVHFLGFVPDEALPRVYAAADCFTIASTAELQSIATLEAMSTGLPVLAADAMALPHLVEEGGNGFLFPPGDISRMSELLLEVLGSPERRRSMGEASRRLVARHDHHRSLERFEAVYESLLVSPPVRSKVQRTMAA

SEQ ID NO: 8170 - protein, 367 aa, Halorussus amylolyticus
MQRVAAFTDTYLPTVNGVTYTVESWRDRWVRDGGRMDVVYPDANGHTPAETEHPVKSLPFPFYDGFRLGTPRIPSDVRDAELVHTHTPFAIGLGGLRLARNRDLPLVASYHTPTSEYANYVSPTDAVASALGRVCESYERWFLEHADAVLAPSAATRDHVRDEVGVDTPVEIVPNGVDVERFRPVEADDFRASRGLDTGRPLIGYTGRHGYEKRLSELVAAAAGMDVTLVFGGDGPARADLERQAESLGADAHFLGFLDRDEMPAFYSALDTFAFPSPVETQGLVALEANACGTPVVGANAGALANTIDDGETGYHYESGDIDDFRAAIRRTLAERDELREACLARRDEVSVERAVERLADVYRRVR

SEQ ID NO: 8171 - protein, 368 aa, Unknown
  Description of Unknown: Halobacteriales archaeon SW_6_65_15 sequence
MSYRVAAFTDTYLPTVNGVSYTIASWRERWERSGGQMDVVYPGADGHSPADGEHPVGSLPFPFYDGFRLGTPRVPEAVRDAEGVHAHTPFSLGLGGLRLARARDLPLVASYHTPTSEYAAYVSPTDAIASLVGRASETYERWFFRRADAVLAPSAATRDHLQNEVGVDTTVEVVPNGVDVERFRPVEPDDFLDRYDLRGDRPLIGYTGRHGYEKRLSELVEAAALLDVTVVFGGDGPARAELERRADDLGADARFLGFLDREEMAAFYSALDAFAFPSPVETQGLVALEANACGTPVVGANAGALANTIDDGETGYNYESGNVEDFRDAIERTLAEREELRETCLARRESMSVEHAVEKLQDVYDSIR

SEQ ID NO: 8172 - protein, 366 aa, Natronomonas moolapensis
MWTVAAVTDTYLPTVNGVSYTVRTWRERWRRRGGEMPVVYPATAARSPDPGECPVPSVPFPFYTGFRIAAPTVPGSVRERGPDVVHAHTPFALGIAGRRLAAALEVPFVVSYHTPAAEYAGYLSDALEGPIRRIADGYERLFLSGADAVIAPSRDAAESLRANGTPTHVVSNGVDTERFRPVDDGTVRAFERRYGLLDRPLIGYTGRHGHEKRLGDVLDATADVDAAVVFAGDGPARPGLERRAAGRDDVSFLGFLDRSELPAFYSALDAFVFPSPVETQGLVALEAIACGTPVVAAAAGALTETVIDGETGTHFPPGDTAALEGAIERTLRGSERLPTRLEERRRRLCVDRSIDDLEAVYESVLE

SEQ ID NO: 8173 - protein, 349 aa, Komagataeibacter europaeus
MRGVMRVLHIMAARGNGGAELYSTDVMLSLHMAGLTQRVVMHPAALRSRELRHAGMAVETGPLRLPLRPLIRHALHRLIERMQPDLIHCWLRRAAELVPAHTGVPVIGWFGNYKDLRPFAHCDWFVGCTPDMAESMRERGAPPDRVAYVPTFPSVMPQAPVSRQSLGTPDDAPVLLVLSRLHPAKGLETLLDALPLLPRCHVWLAGEGELKAALAAQAARLGIADRVHFLGWRSDRGALLAAADICVLPSRYEPFGTVILDAWSADVPLVACAAAGPRAHVRDGDNGMLVPIDDAPALTTAMQRVLDDPALAARIVAGGRRDYEARFTRQAVTAQWLALYERVLSARGR

SEQ ID NO: 8174 - protein, 369 aa, Halolamina sediminis
MESVAAFTDTYLPTVNGVTYTVQSWRDRWRERGGRMEIVYPDSPDRAPEADEHPVRSLPLPIYAGYRLGLPRVPDAVTDVDVVHAHTPFSLGLAGMRLARSRDLPLVATYHTPTSEYASYLSSWGPIRKRTAALSRRYESWFLNRADAVIVPSAATGEYVATELGVDDPQVVPNGVDTERFRPVDSAAFRERHGLPDDRTLVGYTGRHGHEKSLPAILAACDRLDRDVTVVFGGDGPARTKLEEAARKRDVDARFLGFLDRDELPAFYAGLDAFLFPSPVETQGLVALEAFACGTPVVGVDSGALSDTVDDGGTGYHFEPGDIDGFAAAIERTLDERVRLRENCLDRRASISVEHAVDRLAEIYAAVRE

SEQ ID NO: 8175 - protein, 424 aa, Unknown
  Description of Unknown: Deltaproteobacteria bacterium sequence
MNILMVTNVFTPHVGGVAKSVRGFTDEIRRIGHRVLVVAPSFEGAPEREEDVIRVPAVQNFNGSDFAVPMPITGRIASALKTFSPEIVHSHHPFLLGDTALRVAASREVPAVFTHHTMYEEYTHYVPGDSPKLKRFVVDLATGYCNLCDAVVAPSETVAELLSRRGVGVRIEVIPTGVDLRVFESGGGGDCRRRSGIPEDAFVVGHVGRLAPEKNMEFLAEAVAAFLSRNANARFLLVGEGPSKRAMLAAFDASGLSGRIHTAGVLEHRELAAAYKAMDVFAFASLTETQGMVLAESMAAGVPVVAVDAPGAREVVRDRENGRLVPRAEGRAFVEALQWIADREPGERRRLAAGAARTASGVSMPRMAAKLLALYESLAVTRRAPKAIEASPWTSARKLIEEEWKILRNIAHAAGEAVLPGSAE

SEQ ID NO: 8176 - protein, 398 aa, Arthrobacter sp.
MTDQSGAKPLKIMIAADTYPPHINGAAQFGYRLAQGMLKRGHEVHVVTFRASTGPSSSAREDDAMVHRLRSHSVPTHEYWRICLPWEIKDDISRYFDEVQPDVVHVQCHYMVGKAVLEEAERRGIRMVATNHFMPQNLDPFLPFPKWFKRIVAKNSWRDMGRVFKRAAAVTTPTPLAAKAMHEHAFLRKVLPVSNGIDAADYELKPGEEIEDLDHPVVLFVGRLAQEKHVDVLIEAVAKTPADLNLHVEVVGGGEVRAALEARTAELGMSNRVRFLGSISNEELRRAYLRCTIFCQPGTAELQSLVTLEAMSASKPVVLANAMALPHLVDEGGNGHLFTPGDSDELARKLTSIMALPDSEREAMGKASREMVNIHSIDETLSTFESLYRGDPVKKEAV

SEQ ID NO: 8177 - protein, 402 aa, Unknown
  Description of Unknown: unclassified Microbacterium sequence
MTTPATPAPSPSPDRPLRVLIGADTFLPHVNGAARFAERLAAGLVARGHDVHVMAPSDGHRNTGVFTEVIEGEPMTMHRLPSWRFLPHDWLTFVLPWRAKHYARRVLDDVKPDVVHIQSHIIIGRGLAREAKKRGIPLIATNHVMAENILDFTTLPDFLDRIFVKLAWADAKRTFALTRAVTTPTRRAADFLESTIDIHGVIPVSCGIDRSNYTADLEPRDANRILFVGRLTSEKGIDVVLHALAQLDPALNATFDVVGGGDQRRNLEQLAAQLGVVDRVTFHGHASEEDLRSLYTRASVFAIASIAELQSIATMEAMASGLPIVAANAVALPHLVHDGENGYLFEPGDADELAARLTDVLTAEPDERRRMQQASLDGVRVHDIGRTLDTFEALYRGRPIPE

SEQ ID NO: 8178 - protein, 412 aa, Unknown
  Description of Unknown: Brachybacterium sp. YJGR34 sequence
MRPAERPADDQQRPLRVLITTDWWEPVVNGVVASVQTLRRELLALGCDVRVLTLSQGIRARNEPGVYRIGSVSAAVVYDRARIGMPASRHVLRDILRWRPDVIHSQAEFSTYVWARRIAKTLSVPLVHTYHTIYEDYTHYYSPSRTVGRKVVGSFSRRVLAGTDAVIVPTAKVARLLRGYGVRRPVHVVPTGLDLQRFRPAETAAERDDVLALRESLGIGADQKVLLSVSRLAKEKNLEEVLEMLAASPRQDLVLVLVGDGPYRDELEDRAATLGVTDRVRFTGQVDPAEVPRWYRAGDVFVSASLSETQGLTFIEALACGLPLLCHRDPSLASVVLEGRTGWQYEETAQFSAHLDELLDDPARRARMSAAALEHARATCGAQEFGRAVLEVYQQARRRRTARLSAPQAAAA

SEQ ID NO: 8179 - protein, 402 aa, Unknown
  Description of Unknown: Brevibacterium luteolum sequence
MTETEQSTAPADRTTLRICIPTETYAPEVNGAATFAQTLATGLAARGHEVHVICPSATETPSTAWEDGVLVHRIRSHRWYLHPTWTICMPWETKPEVSRLLDLIRPDVVHTQAHFVIGRYALSESRKRGIPVVATNHFMPDNVRPYVNASKRLLRYGSAAAWWDLRRSFEKADYLTVPTQLSADLLTENGFRSSIQAVSCGIDLSHFFAADDVDQTHPTVLFVGRLSLEKNIGDIIAALAAADPSLNLHAEIIGAGSEAEPLRAQAAELGVADRVRLRGKVSDEELVKAYQEATFFCMPSTAELQSIATLEAMASGKPVVLADAVALPHLCRHGENGYLFEPRNIEALTDAFTRLLTMSAADRQQMGDASRRLVARHDVRHTLDTFESIYRQVIAEAQSAAG

SEQ ID NO: 8180 - protein, 368 aa, Haloferax mucosum
MQSVAAFTDTYLPTVNGVTYTIQTWRERWQRRGGRMDVIFPDDDTYDPEAGEYAVRSLPFPFYEGLRIGAPRIPKAVESADIVHAHTPFGLGLAGLRLARRRNLPLVATYHTPTAEYAEYLSSVGAIERGVERTAARYERWFFDRADAVIVPSEDAKRRLTDEVGVDADIAVLSNGIDTEQFAPVEGDAFRRRHGLGDGPIIGYTGRHGYEKHLDELVRAAADLDVTLVFGGDGPARDQLERLADTLGVDARFLGFLDREDLPAFYSMLDVFCFPSPVETQGLVALEANACGTPVVGVNEGALEDTVADGMTGYHYESGDLEGFRHGIRRALTEHDDLSENCLARRDEVSVEHSVDKLAALYDRVMAR

SEQ ID NO: 8181 - protein, 394 aa, Leifsonia aquatica
MGCDTFAPDVNGAARFAERLSAGLVEHGHDVHIVAPAASRKHGTWIEEHEGQKLTAHRLRSWRWYPHDWLRFALPWTSKANARRVLDEVKPDVVHFQSHIVVGRGLAYEAQKRGIRIIATNHVMPENIIEFTRLPKFLHQTFVDIAWRDARKSFDRAEAITTPTQKAAQFLEKATGLRGVHAISCGIDAQNYTPDFTPRTANRILFVGRVTGEKQIDVLLKAITLLPASLDAQLEIVGGGDQFKNLQAMAESLGIGDRVTFLGYVTDEELRAAYTRATVFAMPSIAELQSIATMEAMASGLPVVAANAMALPHLVHDGENGHLFTPGDAQDLADKLESVLTLPQEELDVLKNASLRIVASHDIQRTISTFESLYRGEPVADPVTDSADSVPSPE

SEQ ID NO: 8182 - protein, 417 aa, Leifsonia sp.
MPDTSGPHPTPPAPAAQKPLTIVMGCDTFAPDVNGAARFAERLAAGLVERGHDVHIVAPAASRKHGTWVEEHEGQKMTVHRLRSWRWYPHDWLRFALPWMSKANARRVLDEVKPDVVHFQSHIVVGRGLAYEAEKRGIRIVATNHVMPENIMEFTVIPKFLQKVLVAVEWRDARKSFDRAEAVTTPTRRAADFLEKATGLRGVHAVSCGIDAHNYTPDFTPRNANRILFVGRVTGEKQIDVLLNAVKLLPESLDARLEIVGGGDQLKNLQAMAETLGIADRVDFLGYVSDEELREAYTRATVFAMPSIAELQSIATMEAMASALPVVAANAMALPHLVHDGENGHLFRPGDAQDLADKLENVLTLPQDELDVLKNASLRIVASHDIQTTISTFESLYRGEPVADPVTDAARSVPASE

SEQ ID NO: 8183 - protein, 370 aa, Unknown
  Description of Unknown: Candidatus Halobonum tyrrellensis G22 sequence
MQTVAAFTDTYLPTVNGVTYTVQSWRRRWNARGGRMDVVFPGAPGYDPEAGEYTTRSVGFPFYEGFRFGLPGVPDAVRDADVVHAHTPFALGLSALALARRTDTPLVASYHTPTAEYADYIAKGAVATGVESVARRYERWYLDRASAVVAPSGPARDHLADIGTRTPIEVVPNGVDVDFFRPVDEETRAAFRERYGLPDGPLVGYTGRHGFEKELDAVVPAVDAADADATLVFGGDGPARERLTEQAAERGVDARFLGFLPREDLPAFYACLDAFLFPSPVETQGLVALEANACGTPVVGVDAGALEDTVVEGVTGYHFARDDEAAFAAAIDRTLAERETLSANCLDRREDTSVEHAVDRLAEVYDGLSG

SEQ ID NO: 8184 - protein, 404 aa, Unknown
  Description of Unknown: Microbacterium telephonicum sequence
MTPTATPEPHPSGGHRPLTIVIGADTFAPDVNGAARFAERLAAGLAGRGHDVHVVTPSVGHRNHGVFTEHIEDQDLTVHRLPGVRWYPHDWLRFVWPWRSKHYARKVLSAVKPDVVHSQSHIVIGRGLTRIAHQRGIPVVATNHVMAENILDFTTLPPLLDKVVVKLAWEDAKRTFDMSRAVTTPTRKAAEFLEATIDIDGVIPISCGIDKRNYTPDLAPRAHSRVLFVGRLTTEKHVEVVLQAVAKLAPELPDITFDIVGGGDQRRALEQWTQKLGLNDRVTFHGRVDEAELRASYSKADVFAIASIAELQSIVTMEAMASGLPVVGANAVALPHLINDGVNGYLFEPGDVDDLADKLRRVLTASPEDYLGMQQASLQGVEIHDIEKTLDTFEKLYRGEPLDA

SEQ ID NO: 8185 - protein, 427 aa, Kocuria palustris
MLPELPLDGVPEPVDGRLRVLVVAETYPPDINGSSQFSHRLAQAMAGRGHDVHIAAPRPSKGRTMTRMDGAVTEHRFRSHTAFTYDTFHLCFPWEVRGEISRLMDELRPDVVHIECHYILGRYFAKEAQSRGIRLIGTNHFIPQNIEQYLPLPDPLRRLYRRFSWRDMASVFRRCDVVTAPTPLAVESMRANGFDFPMHALSNGIDAAQYDLKPGEVLPPRDRPTVLFVGRLDPEKHIDVLLRAVASIADRSDVGVEIVGQGGEYDRLAELAQQLGIADRTVFRGFVSDEELRVAYLRADAFCQPGTAELQSLVSLEAMAASSPVLLADARALPHLVDEGVNGWLFPPGDHEQLGRLLLRLLELPEDQRREMGAASRRMVAEHSFSATIDVFEQLYRGVDPDLLLGSWPQTGPLPIVPPASGPGSGD

SEQ ID NO: 8186 - protein, 444 aa, Halomonas salina
MNVLMFTNTYLPIVGGVSESVQRLKRQLQAAGHRVLVVAPRMSGQPEHETDVVRVVAMQYFNGSDFSLPVPIPGQLHEAIEAFDPDIVHAHHPFLLGDTAARAAETYGLPLIFTHHTLYEHYTHYVPGDSPRMQRFAVALATQYTWLCDEVIAPSESIRDLLLGREANPRISVVPSGVDTARFASGEGQRWRDRLGIPASAYVIGHLGRLALEKNLAFLSEAVAETLVSKPDAHFLVVGEGEARDDIQALAKARGVAERLHITGRLQGQALIDAYHAMDVFAFASHSETQGMVVAEAMATGLPVVAVDAPGVREVVVDGRNGRLLAEDDVAAMADALGALADPEIRRPLAEAALETAAGYDEARCAERCLAVYRRAIARGGPFTHADEGGWERMRYRLGAEWQMLCYRGRLLRHLVQEEWEQERPAWWPGHRAEGKRKSEVPRE

SEQ ID NO: 8187 - protein, 391 aa, Micrococcus lylae
MIAADTYPPDVNGAATFCFRLATALHERGHDVHVVAARNDDGPDFVEHRPEATVHRLKSWRPPTHEYYRLVFPPLARRAMRRIMAEVQPDVVHVHCHYMIGAAAITEAERRRVRTISTNHFMPENLEPFLPFPQWFLDRYSRYSWWQMGRLMGKGAVVTTPTALAARAMAERAGLQNVLPVSNGIDASKYEQAAGEVITPHAHPTVLFVGRLAVEKNIDVLLRAVAHLKDTRPELDVHAEIVGDGEQRDVLRELVVELGIEDRVAMRGHVTEEELHTAYLRADVFCQPGTAELQSLVSLEAMSASKPVVLADALALPHLADDGVNGYLFVPGDHEDLAEKLARVLGASPEERVRMGEASHAKALRHSAQKTVDIFEALYRGATPAEVRARL

SEQ ID NO: 8188 - protein, 426 aa, Unknown
  Description of Unknown: Desulfobulbaceae bacterium BRH_c16a sequence
MNISMFTNTYLPHVGGVARSISTFAEDLRKAGHRVQIVAPTYAGLEEVKEKDIVRVPAFQNFNGSDFSVRIPFTGVINRAITDFRPDIIHSHHPFLLGDTALRVARSLDLPLVFTHHTLYEKYTHYVPFDSDALKRFVIQLATEYANLCHRVIAPSTDVKKLLISRGVQTIMNVLPTGIDVDFFKNGDGKRFRREHGIPEDTMVIGHVGRLAKEKNLPFLAGAVARALRKYGNACFLVAGKGDAEPEIKEIFEEQRLDKRLIMAGSLTGNNLADCYAAMDIFAFASLSETQGLVLAEAMAAATPVVALSASGVNDVMKDGVNGIRLEENTSEGQFGDALAQALADRKQLLSWSRNAFETAKTFSREKSTETLLQLYTKTISGVQNSQVAEIDVLDGALLAIKTEWELLQEKTAAALNSFSEVRKER

SEQ ID NO: 8189 - protein, 424 aa, Nocardiopsis sp.
MSTSFAPHPPTVTGPAPSGGGRRRSRVLIGTDTYPPDVNGAAYFTARLVRGLTERGVDVHLVCPSPTGPPHVVERDGVVEHRLRSMPSLAHESVRLALPTGVRGHLNRLLDRLRPDAVHIQNHFLVGRMLTGAACDHGVPVVATNHFMPENLFDHLRMPWPLRPYAARLAWWDLNRILGRAEHVTTPTPTAARLLREQGFVHTVEAVSCGIDLDRFRPLPEDSEVDERRRLRARFGLPDRPTMLFVGRLDEEKRIDELVRAVARTSDVQLVLAGQGSHRERSAELARSEGVADRVRFLGFVAHEDLPDVYRCADVFTIAGIAELQSIATLEAMASGLPVVAADAMALPHLVEEGRNGHLYEPGDPDGLADRVESVVTSERNRARMGEHSRLMASRHRLEDSLKRFERIYEDASVGAFASFSGGR

SEQ ID NO: 8190 - protein, 456 aa, Halomonas sp.
MSQHRRHPLSHPLSESEIASLSQLANGNAITQQREAERESRLASALTLFHSTTPATAMPLGGMKVLMISDVYFPRVNGVSTSIASFRGALERLGHSVTLICPDYPVGQVDEPGVLRIPSRGVPGDPEDRMMRYRDLLALAPSLAGETFDLIHVHTPFTAHYAGVALGRRLGLPVVATYHTLFEEYIHHYIRWLPRRWLRFAARRLSVHQCQQLDALVAPSRAMQHALAHYGVTTPIMVIATGLALEAFCHPQGAQDASDFRAHYDLPTDARLLLYVGRAAFEKNIDFLIDMLPQVLVEYPTTRLIITGEGPAHETLVKRAQEIGVADAVLFLGYLDRNGPLQAAYRAADVFVFASRTETQGLVLLEAMALGTPVVSTAMMGTLDVLKEGEGCLIAEDTHDDFAAKVNRLLGNEPLRQQLAERAQTYAASWHEDAKSVELVELYQQLAVDRCERIGR

SEQ ID NO: 8191 - protein, 427 aa, Pseudoclavibacter bifida
MTKPLRLLIAADTFPPNVNGAATFTVNLASGMAARGHDVHVVAPAASRRHGTWTEEYDGQQITVHRLPSDRYYPHDWLRYVKPWRARHHMRRVLDEVQPDVIHYQSAVVLGRAAVREGAGRGIRIIGTNHLMLENMGDHTLLPNFLQNIAAKIWWHDAHKTFAETEALTTPTRRAANFLEENGQLEGVLAISCGLRTTDYTPRFEPKTPRSILFVGRVTGEKQIDVLMRAFQQLNNVPDLRLEIVGGGDQKENLQKLSRELGIDDRVLFHGYVTDQELRKIYSDATIFAIASIAELQSIATMEAMASGLPVVAANAMALPHLVHEGENGFLFEPGDVGGCATALRTMLEMPREEREQFGRRGLEMVQVHDIDRTMELFERLYYGEDPVSVGKDSWNEQDHSLDDVVEPVTGALPIIRKPESNAQDGE

SEQ ID NO: 8192 - protein, 426 aa, Nocardiopsis dassonvillei
MSTSFASPAVAAPPRPAVGATRRTRVLIGTDTYPPDVNGAAYFTARLARGLAARGARVHVVCPSPEGAPYTAERGGVVEHRLRSVSSLVHDSVRLAVPLGVRGHLDRLLDRVRPDAVHIQNHFLVGRMLAAAAHARGVPVVATNHFMPENLFDYVHVPAPLRPHAARLAWWDLGAVLSRAEHVTTPTPAAARLLVDQGFTRPVEPVSCGIDLDRFSPLDGGAATRRRLRARLGVPDHRTVLFVGRLDEEKRVDELVRAVALTDGVQLVLAGHGAHRARLEELAAEVGAADRVVFLGFVPHADLPDVYRCADVWAIAGTAELQSIATLEAMASGLPVVAADAMALPHLVEEGGNGYLYPPGSPGALAARVESVVADEGRRLGMGARSRDMAELHRLEDSLERFERIYREASAGAGAGAGAGATRSGR

SEQ ID NO: 8193 - protein, 811 aa, Unknown
  Description of Unknown: Candidatus Rokubacteria bacterium sequence
MQLRLPPHRRRACRRVSRARRARRRGQPAGRARERALAVPLRAGRHRLSQATAAAGRHLPVVRPSRPRRAADPARQGAPGGRRAGARARLHAAARRRARGCPGLAAVAGGAHAAAGARRVLRGAPEPLRVRVALSHAPARLLAGAARAGRGRRRRGGRAPARGGGGAAPLVEGPAVSGRPGISVVLITRNEATRIRTCLDSVRWAEEIVVVDQHSGDGTAAICREYGARVIAREMRAGFGEQKNFALAQATQPWVLSLDADEEVTEPLRREIEAAVAAPAGCVGFSMPRLTSYLGRFIRHCGWYPGAVLRLFERGCGRFTDALVHEGVEVDGPVGELRSDLLHRSYDSLADHVRKLLLYTAYDARMLQQRGEPVSGLAGAWRLAVKPPAVFVRKYVLQRGFRDGWHGFVLSAMSALVVLVNHVRLAELTGRLPVTPPPTPWLEPEPPTVLLMANFADLVGGGEESLLALAARLDRHRVRPIATVPAEGEMADRLRALGVPVTVLPLPRLRPWSAAAIGFTLKRLNRLLVAERVALVHAHGGRGAVYAGLVGRNTGTPLVWHARIADPDRWLDPLLVRLAHTIIANSGATACRFRRWPRARVTVVPNGVDLGRFTPRPADPELRRTLGLPATGPVVGYVGRLERGKGPDVLLAAAELLALKVPSVTLLVVGDGPLRLPLAARAASAGVRAVFTGQRGDIPALLRLCDSVAVPSRQEAFGRIIIEAMAARVPVVASAVGGIPEVCADRFTGLLVPPEDPDALAAALAATLTDATASTSRVRAAAADVATRFDIRVHAARVHAVYDGVLQETRR

SEQ ID NO: 8194 - protein, 398 aa, Arthrobacter sp.
MTMPDAQRPLTILIAADTYPPHVNGAAQFGYRLAKGMTGRGHDVHVLACRPDKGKSFTEFRAEGTVHRIRSHSVPTHEYFRITFPWEIKKEISLLFDRVKPDVVHIQSHYMIGEHVLYEAEKRGIRIVATNHFMPENLNPFLPFPQWFKDIIGKISWKDMGKVMGKADVVTTPTPLAAKAMHQHAFLRKVLPLSNGIDSAAYEPRPDEVIEPHAYPTVLFAGRLAEEKHVDVLIRAVAASPADLNVHLEIVGGGEVRPALESLVERLGLRDRVKFLGMASDEDLRQAYIKADIFCMPGTAELQSLVTLEAMSASTPVLLADAMALPHLVRDGENGYLFTPNDSADLAAKLTRILRLPAEERKAMGHASRCMVEPHSIQGTLQTFEDLYRGASYDDKVV

SEQ ID NO: 8195 - protein, 390 aa, Nesterenkonia jeotgali
MRILIAADTYPPDVNGAAVFSHRLAKSMAARGHEVHIAAARTSRGPDMVEHTDEATVHRFRSFKAPTHEYIRLCLPWLVEPAMGRLMDELQPDVVHVQCHYMIGKAAIDAAAERGVRTIATNHFMPENLDPFLPFPDWFRRIVAKNSWRDMGKLMGKAAVVTTPTPLAARTMMQRAGFEKVLPLSNGIDVDYYRLGPEDVLTPPARPTVLFVGRLAVEKNVDVLIEAIAKTDPALGIGLDIVGDGEQRAGLAAQIQQLGLGDRVRMRGHVGEDALRRAYLEADVFCQPGTAELQSLVSLEAMSAGTPVVLADALALPHLVEEGVNGYLFEPGNSAHLAARLEQLFTLSPEQRTRMGERSQERAGRHSLKTTMDAFEKLYRGADWIEGRTP

SEQ ID NO: 8196 - protein, 389 aa, Pseudonocardia asaccharolytica
MPPLRIVIGADTYPPDVNGAARFAERLATGLAGRGHDVHVVAPSPDGPAGRDRRDGLTVHRIRSYRYPLHENFRICLPWQAGPATATVLDDLDPDVVHVQAHFVVGRGLAVAASGAGRPLVATNHFMPENLFAHARVPGSLRQAAARWAWRDLARVFGRAAVVSAPTPRAVQLLAESAGIAGALPVSCGIDADRYAGGVEADVPTVLFVGRLDQEKRVDELLRAFALLPAGLPARLEIVGDGARRGAWTALAEELGPAERVRFAGFVSEEELLAAYRRCAVFCMPGVAELQSLATLEAMSASKPVVAADAMALPHLVRPGRNGWLYQPGDVEALSARLATLLADAPLRRRMGAVSRQIAGSHALGKTLDRFEDLYRRVLGHTTDRIAAA

SEQ ID NO: 8197 - protein, 368 aa, Unknown
  Description of Unknown: unclassified Haloferax sequence
MQSVAAFTDTYLPTVNGVTYTIQTWRERWHRRGGRMDVVFPADDDYDPEPGEYGVRSLPFPFYEGIRIGAPRIPGAVDDVDVVHAHTPFGLGLAGLRLARRRDLPLVASYHTPTGEYAEYLSSVGAIERGVERTAERYERWFFDRADAVIVPSEDAERRLVDEVGVEAEIVVLSNGIDAERFEPVEGGDFRRRYDLGDGPLIGYTGRHGYEKRLDELVRAAADLDATLVFGGDGPAREELVALADDLGADAHFLGFLDREELPAFYSALDVFCFPSPVETQGLVALEANACGTPVVGVNEGALEDTVLDGVTGYHYESGDLEGFRRGIRRALAEREALSARCLDRRDEVSVDRSVDRLAALYDRLASK

SEQ ID NO: 8198 - protein, 368 aa, Halorientalis persicus
MGRTVAVFTDTYLPTVNGVTYTVQTWRQRWAERGGRMPIVYPGADDYEPADDEFPVRSFEFPFYDEFNAAMPRVPDDITAAEPDLVHTHTPFLLGLSGLKFARSNGIPLVASYHTPTAEYADYIAEGWLRSPVERAARTYEKWYLNRAEMVVVPSEPARHHLREIGVRTAVEVVPNGVDTDRFGPVDTSRFVEAHDLDTGKPLVGYTGRHGFEKQLDLIVEATDGMDVTVVFGGDGPARDRLQRLAADADVDARFLGFLDREDLPAFYSALDVFAFPSPVETQGLVALEANACGTPVAAVDAGALSDTVVTGETGYRAPPGDAEGFRAAIERTLAERDALSEHCLDRRDAISVDHAVDKLADVYEMLL

SEQ ID NO: 8199 - protein, 462 aa, Nesterenkonia sp.
MPSSAGCAQPASIPGAAAAGRSLGCVCLRAIRCCTRTKKAGHPQRRRPLSSRRTARSGREDAASVSDRPPLRILIAADTYPPDINGAAVFGHRLAKHMAARGHQVHIAAARTGPGPDTVEQRDEATVHRFRSFKAPTHEYYRLCLPWLVEPAMHRLVQTIQPDVVHVQCHYMIGKAAILAAEAARVRTVATNHFMPENLDPFLPFPQWFKRIVAKNSWKDMRRLMGKAAVVTTPTPLAAETMRVKGGFDHVLPLSNGIDVDYYSLRPGERIPKRDRPTVLFVGRLAVEKNVDVLLEAVAKTDPSLEITAEIVGDGEQRDALREQAAALGIQERVVFRGFLDEAPLREAYIAADVFCQPGTAELQSLVSLEAMSAANPVVLADALALPHLVAEGENGYLFEPFNSDQLAQQLNRVFRKTPQQRAAMGALSREKAGQHAIGKTMAAYEALYYGSDWVDTYQFEY

SEQ ID NO: 8200 - protein, 420 aa, Leifsonia sp.
MPDTSGQPSSTPAQPPVPAKKPLTVVIGADTFAPDVNGAARFAERLAAGLVSRGHDVHIVAPAASRKHGTWVEEHEGQKMTAHRLYSWRWYPHDWLRFAIPWRIKQNSARILDEVKPDVVHFQSHIVVGRGLSQEAQKRGIRIIGTNHFMPENMLEFTLLPRFIQDYAIGLAWKAARRTFGRAEAVTTPTAKAAQFLEKYTGLRNVHAISCGIDAHNYTPDFTPRTGNRILFVGRVTGEKQIDVLLKAVSLLPSDLDAQLEIVGGGDQLKNLQSLAEQLGIADRVTFTGYVTDEELRQAYTRATVFGMPSIAELQSIATMEAMASALPVVAANAMALPHLVHDGENGYLFEPGNAQHLADRLEHVLTLPQEELDVLKNASLRIVAAHDIQTTISTFESLYRGEPVADPVTESAPPVPSTD

SEQ ID NO: 8201 - protein, 456 aa, Halomonas sp.
MPQRRRPPLSASLSDQEVAALTQLANGNALHRQREADRQARQASALTLLHATASTAETQPGSMKILMISDVYFPRVNGVSTSIASFRGALERLGHSVTLICPDYPLGQVDEPGVMRIRSRRIPGDPEDRMMRYRDLLALTPQLADVAFDLIHVHTPFTAHYAGVALGRRLNIPVIATYHTLFEEYIHHYIRWLPRGWLRLAARRLSVHQCQQLDALVAPSRAMQDALSRYGVTTPTTVIATGLALESFCHSQGGQDDSDFRTHYNLPQEAQLLLYVGRAAFEKNIDFLIDMLPKVLAEHPTTRLIITGEGPAHDSLVQRAREIGVAESVLFLGYLNRSGPLQAAYRAADVFVFASRTETQGLVLLEAMALGTPVVSTAMMGTLDVLKEGEGCLIAEDNHDDFATKVNRLLNDEPLRQQLAGRAQTYAASWHEDAKSTELVGLYQQLAAEHLEKTVK

SEQ ID NO: 8202 - protein, 485 aa, Unknown
  Description of Unknown: Gemmatimonadetes bacterium sequence
TIAVSVAVANALRRRLHPRGRLRVVPNGIDLARVEAEPSQQDLAMAQAALGGDSGRPVVAVVARRKDQQILLRALPALARPVTVVFVGIGPDKVLAAAAAAVPERHRIVFVPFTEHPLAFYRLATVAALPSRIEGLSQSLLEAMSLGVPVIASAAGGNPDLISPGETGLLVPPLDPAAWTRALDRMLGDDEFRARVARAGRAHARQEFTMPRTAERTEIVYCEAIERRRLLAGERPGTTPLTVVIPTLNEASQIGDCVRGLAWAGEVIVVDASSKDGTAATAAAAGARVLDGMAPGIAAQRNTGIAAAKHEWVFALDADERIGPALAAELAQVVVAPQHEAYRVKRRNLFHGHVLRRGHWGRDWVVRLFRRGRRFGGASAHPGLEFPEREQGELANELDHTPYKDLGHHLDKLITYSRMSAADLAAQGHRATFSDVALRPAFRFWRDYILHGSIFDGRLGVIHAGMSAASVFLKYAFLWERQRRG

SEQ ID NO: 8203 - protein, 369 aa, Unknown
  Description of Unknown: Halobacteriaceae archaeon SHR37 sequence
MATTESVAAFTDLYFPTVNGVAYTVALWRERWPHCRGTMDIVYPEMDGYEPDDGEYALSSVSAPLYPRYRLGVPTIPRGLETPDIVHVHTPFTVGFAGIRFARKRDVPVVASYHTLLEDRVNQHLPGSLVDGFKRTCRTYERAFFERVDHVTAPTSFARRHLLEHVEADVDVTVVSNGIDTEFFRPLESETFRDRHDLPDGPLLGYTGRHGPEKSIGEAIDAVDGTDYALVIAGDGPAREDLEARAATADAEIRFLGFLEREELPAFYSALDAFVFPSRVETQGLVALEATACGTPVVAVDAGALTDSVIEGETGYRYAPDDLEGFRWAIRRTLAERDRLSDLCRRRRPMLSADHSLEQLARIYDGIRG

SEQ ID NO: 8204 - protein, 391 aa, Unknown
  Description of Unknown: Propionibacteriaceae bacterium NML 130396 sequence
MKILIGHDTYPPDVNGAARFTERLATGLVARGHEVHLIAPSHTGREFVEDRDGVVVHRLPSHRYPLVDQFMICMPWQAGPRIKRILDEVQPDVAHIQGHMLIGRLLSKQATERGLPLVATNHFMPENLVELVKIPHRARRAVSRLAWKDCANILGRAQVVTAPTPRAVELLAGSAGLPGGLAISCGIDPEPYLAASRAAKHDRHLRVLFVGRLDQEKRVNELIRAFARLPKDLDVRLEVVGDGSFADQWKALAGSEGVADRTTFLGFVSEEELLAAYGRCDVFCMPGVAELQSLVTLESMAAGKPVVAANAMALPHLVHPDENGFLYSPGDVDELATHLGRLLSDPDLRRRMGAASREIVHQHALNATLGRFEELYREVSGGQVVPLRKAA

SEQ ID NO: 8205 - protein, 421 aa, Unknown
  Description of Unknown: Brachybacterium phenoliresistens sequence
MSETHRPSSPTLKVLLTTDWWEPVVNGVVASVTTLRRELESLGCEVRVLTLAPGLRSRRRDGVYELGSVSAALVYDQARIGMLSNRGVLREILDWGPDVVHSQCEFSTHVWARRIARDLDVPLVHTYHTIYEDYTHYYSPSRTMGRKAVATFSRKLLHSTDAVIAPTAKVARLLEGYRVERPVHVVPTGLDLERFRPARTAAERSDAASLRESLGIAPQDTVLLSVCRLAKEKNLDEVLDHVAAVDRPDAVLVLVGDGPYRAELEERAARLGVSDRVRFVGVVDPEEVARWYRIGDVFVSASLSETQGLTFIEALACGLPLLCRRDESLEAVVLEGETGYCYEDSAGFERGLSAIADSSAQRERMAAAALEHARTTCGAEAFARSVLDVYSGVVARRADARYMGAALTAACLMGEDLGVSA

SEQ ID NO: 8206 - protein, 391 aa, Gryllotalpicola sp.
MGCDTFAPDVNGAARFAERLAAGLVERGHTVHVIAPSQTVFRTGHWDETHAGARLHMHRLFSLRWYPHPWLRYMMPWTIRRNTSRILDQIKPDAVHFQSHFVVGRGLSVTARSRGIRVVATNHTMPENMIEHTTLPKFMQPALLKWAWWDATKILKRADAVTTPTRRAADYLEEATGITGVHAIGNGVRVSDYTPDFEHRGSRIVFVGRITGEKRLEVLVHAVALLPKSLDWSLEIVGDGEQRHHLERLAAQLGVGERVTLAGLVSDAELKQAYTRADVLAMPSTAELQSIVTMEAMSSGLPVVAADAMALPHLVHDGENGFLFRPDDAQDLAAKLEKILTLPDEEFTRMKKASLRLIQAHDIERTLTTFECLYRGKPVVDPVTEEVTEGR

SEQ ID NO: 8207 - protein, 389 aa, Unknown
  Description of Unknown: Micrococcales bacterium 32- 70-13 sequence
MCVLIGADTFPPDVNGAARFARDHAVRLARRGHDVHVVAPAVSMRSRSGIEFYDGQAIHVHRLRSIRWPFHEWLRVTPPWEVRRQVRRIVNDVQPAVVHLQSFIDIGRGLAYEAQRAGVPLVATNHVMPDNVIEFSGLPRTLQPRLARFGWNLASTVYSLADVVTSPTPTAARYLEEQTDLRGVIPVSCGIDLDRFTPKQTRPRENRVLFVGRLDPEKNLTTLLTAFSLIRSDLNARLDIVGGGAERDRLVQTAVQLGITSRVTFHGYVTDHELVGLHHRATVFVMPSTAELQSIATLEALASGTPVVLANAMALPHLVANGEEGYLAQPGNAHEFADLIERILQLTDASYARMSRAALTTARSHDAGAITLRYEQLYRDAWLSPLPAA

SEQ ID NO: 8208 - protein, 660 aa, Amycolatopsis sp.
MTALAIVCALAAAVLFALAASRQHAEVTDLAVDGTPGLRSLARLLRSPGWWAGTGLATGGSLLHVVALSLAPLPVVQPLGVLSLVLTVLFGRRARNRRVVAAVVLVVAGVAGFVALAASAAPVTNINAETAEVVAVTGFAVAALAWFARAGCTALAAAAAVLFGLGASVVHAAASQAPAIAVLLGGQALLLLGAGGVILHRAYAAGPTAVVVGTTTVLDPLTAVAVAALAYGEVPQPAAALAAVVALAGVRVLAGAVPQVPPKSEENPVHPTGLRVLIGADTFPPNINGAAFFAERLARGLVGRGHDVHVVCPSDDGPARTERRDGYTIHRLRSRAIPFHSEYRFCTPGGARTAAGEILDRVRPNVVHVQAHFGVGRALLEAAAERDVPGMATNHFMPDNLLGYTPFPRWLKDAITRWAWKDLVRVYRDTRIVTTPTPRAAQVLAGIGLDRPAQVVSCGIDLAHYAAPARPADRPMSVLFVGRLDAEKNIDQLLRALAPLPHVRADLVGDGTRRHELEDLAAELGVTDRVTFHGFVSDAELVHRYAAADVFCMPGTAELQSLATMEAMAAGLPVIAADALALPHLVHHGENGYLFEPGAITTISRWIADLAADPETRARMGEASRAVIARHDIDGTLTTFETQYRTLLGLSTPVTVGQAA

SEQ ID NO: 8209 - protein, 400 aa, Herbiconiux solani
MGADTFTPDVNGSARFAEHLASGLAGRGHEVHVVVPSAKLPVGTRTEVFDGQEVIVHRLYSWRWYPHDWLTFALPWRIKQNSARIIDEVKPDVVHFQSHIIVGRGVSTEAEKRGIRIVGTNHVMPENMLAFTGIPKFLQNWAIGLAWAAARRSFIRADAVTAPTRRAADFFEEATGIGNVYAISCGINASSYTPDFEPRKENRVLFVGRVAGEKHIDVLLKAIALLPADLDTKVEIVGGGDQLKNLQAMAQQLGLGDRATFTGYVTEEELRKAYTRSTVFAMPSIAELQSIATMEAMASGLPVVAADAMALPHLVHDGENGFLFRPGEERDLADKLERVLRMPQDELARFKNESLAIVAAHDIDRTLTTFEHIYRGEPVTDPLVVPHAKVPDRGQGDSAA

SEQ ID NO: 8210 - protein, 429 aa, Microbulbifer mangrovi
MNIVMLTNTYLPHVGGVARSVQAFCNEYRKRGHQVLVVAPEFSEKIANEKDVVRVPAIQNFNGSDFSVALPLSGELTERLDFFEPDLVHSHHPFLLGMTALRIARSRELPLIFTHHTLYERYTHYVPADSEALKRFVIELATRYGNLASMVFAPSESVAELLHERGVKTPIQVVPTGVKLEDYQHGNGKKAREQYGIPENAFVVGHLGRLAEEKNLIFLSEAVIELMVRNDDLHFLVVGTGPIQDRIRALFEEHRLGHRLHLTGTLQGQPQSDAYNAMDVFGFASTSETQGMVLTEAMAAGVPVVALDASGCREVVEDRINGRLILKQSTREMIGGLQWVYDLPTGEYRELCQAARETAERFSMENCATAALNHYQSLVHQHWPLDDSLYAQWMRLRNMIGAQWEIIEGVTSAASAALDPEHSSKSHLQ

SEQ ID NO: 8211 - protein, 412 aa, Microtetraspora malaysiensis
MPTVNSPDTPDAGPASPAPMGRRVLIATDTYPPDVNGAAYFTHRLAAGLAERGNDVHVVCASEQGPPRIETAGDVTVHRLRSAPLLVHPTMRVGVPAGLGRTMSRLIQGLRPDVVHVQGHFVVGRAAVGAARRAGRPVVATNHFMPDNLFPFARVPARLRDVADRMAWRDVARVFSRADHVTTPTKIAAELLAAKGFTGVVEAVSCGIDLDRFRPRPWDRIRARERFGLPDLPTVLFVGRLDEEKRLDDLILALPQVLNHVEAQVVLAGTGGRRAALERLASRIGARERVRFLGFVPDADLPLAYAAADVFAMPGIAELQSIATLEAMASGLPVVAADAMALPHLVDGNGHLYPPGDVRAMARQLTAILTDSGLRAAMGRAGLALAASHDHRLSLARFEEIYAELTTRSVRA

SEQ ID NO: 8212 - protein, 669 aa, Prauserella shujinwangii
MLTLAIGLAAAGACCFAGTVHLQHRAVHQASAGREGRSLGLPAVQTILRNPGWYAGIGLAGLGAVLHVLALTMAPLAVVQPIGVLTLVLTVLLARTVLTRAVLAALVMSVAGVAGFVALAAMTTDAALPPPDLASAQWAVLGAAVLAVAARYTRDRARCLFLALATAVLFGFTSALVRAAAVAPLSGGMAVLVVAEALAAALAGVWLLHQAYASGPAAIVAGATTIVDPLSAVVIGVFAYGEMAPGQLAGMVVPGAVAVAGLALLAREVPAAPTGPARRKRRAGPLRIAITADTYPPHVNGAANFAYRLASGLAGRGHEVHVVCPSTGGETFTETAGGVTVHRIGSLRTPFHPTFRFCPPWRASKAVPALLAEIEPDVVHTQAHFLIGRSAVRAATAAGVPVVATNHFMPENLLGYGPLPRFTHRPLARLAWRDLARVFGRATVCTTPTPRAAELLERNGLNRPVMAISCGIDRAHYAGPPEPTSAPAVLFVGRLDAEKNVHELLEAAALLPDVCVELVGDGSERHRLAALATRLGIADRVRFHGFVPDEELVRAYRRCDVFCMPGTAELQSLVTMEAMAAGKPVVAANAMALPHLVRPGHNGWLYPPGDVPELARLLAAVLADEHTRTAMGKASLDLIAAHDLESTLDQFDRVYLDITARPMVSALQR

SEQ ID NO: 8213 - protein, 368 aa, Unknown
  Description of Unknown: Halobacteriales archaeon QS_8_69_26 sequence
MDYRVTAFTDTYLPTVNGVTYTLKCWRDRWNGNGGCMDVVFPRANGYDPGRGEHPVRSLPFPFYDGFRLGVPSVPKGARDADLVHAHTPFALGLSGLRLARKRDVPLVSSYHTPAGEYAGYLGPTPWAEDKIRGAAETYERLFFDRSDVLIVPSKAAMRHVKSQVGVAADVRVVSNGVDTDRFRPVDHGEFLVRHDLPTDRPIVGYTGRQGYEKRVRDLVDAAEGLDATVVLGGDGPAREDLEARAADVDGDVRFLGFLDREELPAFYSAMDVFAFPSPVETQGLVAMEANACGTPVVGADAGALADTVEEGVTGYRFPEGDVETVRERIRRALDERDRLSEHCLDRREAHSVERSLERLRGIYRELI

SEQ ID NO: 8214 - protein, 382 aa, Unknown
  Description of Unknown: Candidatus Rokubacteria bacterium sequence
MRIALYTNNYLPFCGGVTISVETLRRGLEAAGHEPWVFGPRLRGARDASPRVVRYPSIPATTYPEFALAVPYSRRIARLVAAIDFDVFHAHHPFLLGPAARRLARRARRPLVFTYHTRYEKYAHYVPLKRALVEAAAVRLSAAFAARADAVLAPSAIIRDELSARGVRAPISVVPTGVDLERFRPGDRAAARRELGIGDGEAVVLYVGRLDREKSVDRVLLAFERIASTVPAARLLLVGHGTQAEQLRRLASSLPVATRIGFLGVRPHHALVECYRAADVFLFASETETQGLVLAEAAACGLPAVAVDAPGCDEVVRDGETGLLTKGDPAALAEAAIGLLLDPERRRGMARRAREVAQRLFDVQLQIDRTMAVYQDVIARVR

SEQ ID NO: 8215 - protein, 401 aa, Sinomonas mesophila
MPAPEPETTQRPLTILVGADTYPPHVNGAAQFGYRLARGMTARGHSVHIVAGRSEKGRSYTETRPEAVVHRLRSHSVPTHEYFRIVFPWEVKKEIALLFDHVQPDVVHIQSHYMIGEHVLYEAVRRGIRVVATNHFMPENLNPFLPFPQWFKDIIGRISWKDMGKVMGQADVVTTPTPLAAKAMHEHAFLREVIPLSNGIDVAAYEQRPGEEIRRNPYPTVLFAGRLAEEKHVDVLIEAIAKTPVELDVHLEIVGGGEVRPALETLVDRLGLRQRVRFLGLAPDEELRSAYLRADLFCMPGTAELQSLVTLEAMSASTPVVLADAMALPHLVREGENGYLFRPNDAADLAEKITAVLGQPADERRRMGAESHRMVQKHGIKATLDTFESLYRGVEPAPEAL

SEQ ID NO: 8216 - protein, 399 aa, Unknown
  Description of Unknown: Microbacterium sp. 1294 sequence
MTPPDDPAPERGPLTIVIAADTFAPDVNGGARFTERLAAGLAARGHDVHVATPSVGHRNHGVFTEDIEGQPLTVHRLPGWRYRPHDWLRFVLPWMGKHYSRRLLDEVDADVVHSQSHIVIGRALTRIANQRGIPVVATNHIMADNILDFTLLPKFLYDIFLKIAWADAERTFKMSRAVTTPTRKAAEFLENTIDISGVVPISCGIRQSNYTPNLEPRENRRRVLFVGRLTTEKHVEVTLEAITKLPDLDIQFEIVGGGDQRKSLGQVTERLGLTDRVTFLGRVSEEELRAAYTRADVFVIASVAELQSIATMEAMASGLPVIAANAVALPHLVHDGENGYLFEPGNADELAEKIRTVLTADQAEYSRMQQASLHGVEIHDIERTLDTFEKLYRGEPLGG

SEQ ID NO: 8217 - protein, 384 aa, Kocuria sp.
MKILITAETYPPDVNGSAQFARRLAHGMLERGHEVHVAAPMPTHGPSRVMADDGVQEHRFRSHHAFTHPYFRLCFPWEIAREVSHLFDEVQPDVVHVQCHYILGRLVIHEAVRRGVRVVGTNHFIPENIEPFLPFPDWFIKGYRKVSWWDIARVYGRCDVITAPTPLAVRTMVDNGVADRAVAVSNGIDAGHYEAAADEDVRHPDHPVVLFCGRLAVEKNVNELIEAIALIPRAKNVHAEIVGEGEQRERLVRLAHERGVADRVQFLGFLTDEELRRAYLRADVFCQPGTAELQSLVTLEAMSASTPVVLANARALPHLAEEGRNGYLFTPGDPADLAAKLQLVLDASPEQQRAMGAHSRAMVSQHSFTRTLDTFERIYGGANR

SEQ ID NO: 8218 - protein, 371 aa, Unknown
  Description of Unknown: halophilic archaeon DL31 sequence
MESVAAFTDTYLPTVNGVTYTVKAWRDRWEARGGRMDVVYPGSDGHDPDPGEHPVRSLPLPLYSGFRVGTPTIPDGLVDPDIVHAHTPFSLGLAALRFAQKKAVPLVVTYHTPTAEYTTYFTDWGPLQDGLSAVSRQYERWFLNHADAVIVPSEATGQYLTEELDIDVPPTVVSNGVDVERFRPVDTMSFRERHNLPADKTLVGYTGRHGHEKCLPDILAACERLSGDVTVVFGGDGPAREELEAEARECNVDARFLGFLDRAELPAFYATLDAFLFPSPIETQGLVALEAFACGTPVVGVDSGALSDTVDDGVTGYHYQRGDIDGFTAAIERTLEECETLREACLEKRGEISVESSVDRLGALYAALSEQ

SEQ ID NO: 8219 - protein, 415 aa, Unknown
  Description of Unknown: Chloroflexi bacterium sequence
MHIAFFTNTYVPVMSGVVQSIRTFRNSLVEQGHNVFIFAQHAEGYKDTEPFVFRYPAISLPMQQKYPVIIPLSPRVDWLMPALKLDVIHSHHPFLLGQAAAAKAADLGVPLVFTYHTRYRAYSHYVPFNQKLVKTAIEDMLAEYMKKCHHIVVPSESIKQILSEVYGIREQMTAIPTGMDLSLWENADGPAVRRSRGWGQDTVLISVGRLAKEKNWPTLIRAAAQVIRHRAGVRLCLIGDGDERRKLEALAAELGVAERVEFTGNIPYRSVIAHLKAADLFCFASESETQGMVTMEAMAAGLPVVAVDATGTRDVVTHGHEGLLTPNHSNALAQAIETVLNDDSARARFAGAALARAQTLSIQAQAKKLVDVYRQAAQDQRAGRYVQITNPDLAAKRSARWLAVLENMFEPDKSG

SEQ ID NO: 8220 - protein, 393 aa, Agromyces sp.
MGADTFTPDVNGAARFAERLAAGLVERGHEVHVMAPAASRKHGTWKEVHEGQEMTAHRLYSWRWYPHDWLRFALPWRIKQNSAKILDRVQPDVVHFQSHIIVGRGLSVEAQKRGIRIVGTNHMMPENMLEFSLIPKAWQEWAVGLAWKAARRSFSRAESVTTPTRRAADFLERATGLRGVHAISCGIDAHKYAPNWEPRTENRIIFVGRVTHEKHIDVLLHAITLLPDELDVKVEIVGGGDQKRNLENLAAELGIADRVTFTGYVTDEELREAYHRASVLAMPSIAELQSIVTMEAMASALPVVAADAMALPHLVHDGENGYLFEPGSAEDLAAKLRLVLEAAPEEYRRMKEESLRLIAAHDIQRTITTFENLYRGKPVTDPVTDNAPAALSE

SEQ ID NO: 8221 - protein, 480 aa, Nostoc punctiforme
MNTLASLNLVKSLENSASETPNSQPVYALISVHGDPTAEIGKEGAGGQNVYVRELGLALAKRGCQVDMFTRREYPDQEEIVELAPGCRTIRLNAGPAKFITRNDLFEYLPEFVEAWLNFQQRTGRSYTLIHTNYWLSAWVGLELKSRLGLPQVHTYHSIGAVKYRNMENPPQISAIRNCVERAILEQADYVISTSPQEAEDLRQLISQHGRIKVIPCGINTEHFGSVSKEVARQQLGIASDSQIILYVGRFDPRKGVETLVRACANLPSAFQLYLVGGCREDGADFKEQQRIESLVNDLGLEAVTVFTGRISQALLPTYYAAGDICVVPSYYEPFGLVAIEAMAARTPVIASNVGGLQHTVVHGETGFLVPPRDSKALAIAIHSLLQNPTLKESYGNAAQNWVQSRFSTQGVAARVHELYQSLTLDTFIQEIIKTKKLTPDLERQIQNLLKSKVLKSNEIKALEKLIDSFSNDIVQWATS

SEQ ID NO: 8222 - protein, 418 aa, Nocardiopsis xinjiangensis
MLRAARPLRVLVATDTYPPDVNGAAYFTHRLAEGLAARGHLVHVLCPSAQGPPHVSVAGGVTEHRVRSARIPFQPTMRAALPLGSGGHVDRLLARFAPDVVHVQSHFTLSRTVLARAQATGIPTVLTNHFMPDNLYAHARVPRSLQSAAGSLAWHDMIRVAEQADHVTTPTPRASRLLREQGLSRQVEAVSCGIDLERFHPRASERSAARARLGVPDRDSIVFVGRLDEEKRIDELVRALALLTTDLDAQLVLAGTGQREGELSELARVLGVRERVRFLGFVPDESLPSVYVAGDVFAIAGVAELQSIATLEAMSTGLPVVAADAMALPHLVIEGRNGYLFPSGEVEVLADRLRAVLSSRAERGFLGAAGREMAAEHDHRRSLERFESLYAQLSGAVSASGTSGEVTRSDRYERIVQG

SEQ ID NO: 8223 - protein, 367 aa, Halogranum gelatinilyticum
MDAVAAFTDTYLPTVNGVTYTVKTWRDQWHARGGRMDVVYPGSDDYTPDDGEYPVRSLPFPFYEGFRLGMPRIPDEVEDVDVVHAHTPFALGLSGLRLARREDIPFVASYHTPTGEYASYITSVESVEDRIEGLSERYEQWFFDHADTVITPSTVTKDYLLNTLGVDTDVTVISNGVDTERFRPVDTDAFRDKYDLDGPLVGYTGRHGYEKCLGDIVDAVAEADVDATLVFGGDGPARESLERRAENRGVDARFLGFLPREELPAFYSVLDAFLFPSPVETQGIVALEANACGTPVVGVNSGALADTVEDGVTGYHFAPGDIDGFAAATRRTLAERETLSENCLASREKISVGHAVDELAAVYERVR

SEQ ID NO: 8224 - protein, 396 aa, Humibacter sp.
MGADTFSPDVNGSAKFAEHLASGLASRGHDVHVVVPAASRAHGTWTEEYDGQKVTAHRLFSLRWPFHDWLRFVMPWTIRKNSARIIDEVQPDVVHFQSHIVVGRGLAAEAQKRGIRIIGTNHVMPENLTAFMPIPQAAKDVVIKLAWKAARRSFSKAEAVTAPTRRAADFFERGTGMTNTYAISCGIRASDYSPDFGPREGNRILFVGRVAPEKQIDVLLKAVQMLPSDLDVHLDVVGGGDQLKNLQQLAETLGIADRVSFTGRVSDEELRASYTRSTVFAMPSIAELQSIATMEALASGLPVVAADAMALPHLVHDGENGYLFTPGDATDLAAKLERVLRLPEDELQAMKRESLDIVAAHDIDRTLATFERLYRGEKVSDPAVSRPSDEERSSAA

SEQ ID NO: 8225 - protein, 400 aa, Unknown
  Description of Unknown: Microbacterium luticocti sequence
MTPAASSADPQRRPLTVLIGADTFLPHVNGAARFAERLAAGLVARGHDVHVSAPSAGHRNHGTFVEEIEGQPMTIHRLPSWRWPPHDWLTFVLPWMSKHYARRVLDEVKPDVVHIQSHIVIGRGLAREARKRGIPIIATNHVMAENIVDFTTLPPLLDKVFIKLAWSDAERTLKMARAVTTPTRRAADFLESTIDISGIVPVSCGIDRTHYRADLTPRETNRVLFVGRLTTEKKIDVLLRAVAALDPALDVHVDIVGRGDQRRNLEGLAHELGLDARVTFHGHTSDDELRDLYTRASVFAIASIAELQSIATMEAMASGLPVVAADAVALPHLVHDGENGYLFPPGDVDALADRLTRVLTADPDERRRMQQASLDGVVIHDINRTLDTFEALYRGEPLPD

SEQ ID NO: 8226 - protein, 397 aa, Unknown
  Description of Unknown: Microbacterium testaceum sequence
MSPGPVPDERPLTVLIGADTFLPHVNGAARFAERLAAGLVARGHDVHVAAPSVGHGHSGTFTEVIEGEPMTMHRLPAYRFLPHDWLTFVLPWRAKHYARRVLDQVKPDVVHIQSHIVIGRGLTREARKRGIPVVATNHVMAENILDFTTLPDFLDRIFVKLAWADAARTFAMTRAVTTPTRRAADFLESTIGIQGVIPISCGIDRSNYTPDLEPRAANRILFVGRLTTEKGIDVVLRALAMLDPALDATFDIVGGGDQRRNLEQLAEQLGLGSRVTFHGHTSEDELRALYTRASVFAIASIAELQSIATMEAMASGLPVVAADAVALPHLVHDGENGYLFEPGNAEELAARLTDVLTAEPEERRRMQQASLDGVIVHDIGRTLDTFEALYRGQPIPE

SEQ ID NO: 8227 - protein, 435 aa, Murinocardiopsis flavida
MTGSAQRYLTSMSRAGRNGGTRRRILIATDTYPPDVNGAGYFTHRLATGLAERGNDVHVVCASAAGRPAIEYADGVVLHRLRSASVLVHPTMRTAVPLGVHGHVARLVDRFAPHVVHSQSHFTISRAAIRAGRLAGTPVVLTNHFMPDNLFAHAHLPGLLHSTAGTLAWRDMIRVAYEADYLTTPTERAAKLLAEKGYSRPVEPVSCGIDLERFQPRPEERSVARAGFGLPDRETMVFVGRLDVEKRIDELIRALPRVAERRDVQLALVGTGQRQEELRRLAHEHGVADRVFFLGFVPDEDLPQVYVAADMFAIGSVAELQSIATLEAMSTGLPVVAANALALPHLVKEGENGFLYPPGDIGALTRRLLEVLESPRRAEMGEASRRIAQTHDHRNSLERFEEIYDKVRSSRPGLARRGILTRVPAQSRRRQAMAA

SEQ ID NO: 8228 - protein, 398 aa, Promicromonospora thailandica
MLRILVAADTFAPDVNGAARFADRLSAGLAGRGHDVHVVAPSPTGSAGTEERDGVVVHRLVSRRMPGLDAMRVCLPWEVSSEVRRVFADVRPDVVHTNGHMLLGRAVVQQALREETPLVATNHLMPENIVGYLPLFGPLRAVFAEWMYRDLGRVYSRADAVTAPTARAVELINRRAGLTAAFPVSNGIDADAYERARVAVAARRSTPGGPDTLYEPTVLFVGRLDQEKRVDELIRAFARIAPDVPGRLQVVGDGACRGAWEALADRLGVAGRVTFLGRVSDDDLMSAYATADVFCMPGVSELQSIVTMEAMAVGLPVVAADAMALPHLVRPGTNGELFTPGDVDGLAGHLRTLLTDVALRERYGTAGRELIEAHTLGATLGIFEALYEKVMSGAPVAA

SEQ ID NO: 8229 - protein, 417 aa, Kocuria polaris
MSADTTTADRPLTVLLGAETYPPDVNGAAQFGHRLARGLHERGHRVHVLCARPEPGPSCRAEDDGVLEHRLRSHRAFTHPYFRLCFPWQVAGEIRRVLDEVRPDVVHVQNHYIIGRMLVREARRRGIRTVATNHFVPENLEPFLPFPAWVLDRYRAVSWRDMVRVFGACDVVTAPTPLAVETMRRNGFPGTVLAVSNGIRIADYEAHDGEQRERGAPPTVLFTGRLAVEKNVDVLIEALSLLPAELDAHLELVGDGEQRSALEKLARALGVAQRVRFLGYVPDEELRAAYLRADVFCQPGTAELQSLVTLEAMAASRPVVLANARALPHLAEDGVNGWLFAPGDAQDLARKLALVLGAPPEERARMGRESRRKVAQHSFPRTLETFLRLYRGQHPEPVRARAAGPGRLRSRLASLVR

SEQ ID NO: 8230 - protein, 382 aa, Unknown
  Description of Unknown: Candidatus Rokubacteria bacterium sequence
MRIALFTNNYLPFCGGVTISVETLRRGLESSGHEAWVFGPRLNGPKDVSDRVVRYPSIPVATYPEFALAVPYSRRIDRLVTALDFDVIHAHHPFLLGPAARRLARRNRRPLVFTYHTRYEKYAHYVPLPLRLVQAAALRISAGFAAQADAVLAPSALIRDELHARGVRTPIAVVPTGVDLQRFRPGDRAAARRSLGVRAADPVVLYVGRLDREKSVDRVLLAFERVASTLPAAQLVLVGQGTETQRLRRMADALPVAGRIRFLGLRPHHALAEHYQAADVFLFASETETQGLVLAEAAACGLPAVAVDAPGCDEVVRDGDTGILTKGDPAALAEAVIGLLLDPERRRAMARRAREMAERLFDVTLQIDRTMAVYADAVARLR

SEQ ID NO: 8231 - protein, 391 aa, Amycolatopsis circi
MPHSRLRIVIGADTFPPDVNGAAHFAERLARGLSARGHEVHILTPQRAEVPEPAAGYTLHYVPSHRTPFHPTFRFSTPRRARRTAAELLDELRPDVVHVQSHFSVGRGLLTAAEERGIPAVATNHFMPENLLGFVSLPEPVTSALTRWAWRDFVRVFRRAGVVTTPTPRAAQLLEEKGFPGPVAVVSCGIDLGHYAPVEPAPANPVRVLFVGRLDAEKNVDDLLRALSKVPSLHATLIGDGSCRTELEHLAARLDVADRVTFRGFVPDAELVRAYRTSHLFCMPGTAELQSLATMEAMAAGLPVLAADAMALPHLVAPGRTGWLYPPGETETLGERLLELTGDPALRARMGRAGQEAVARHGIARTLDAYEGLYQAATGALLHTPVTGQAA

SEQ ID NO: 8232 - protein, 388 aa, Chthonomonas calidirosea
MRIALFSECYTPVLNGVVIAIQTLRETLRSMGHEVFIFAAGDPQPDDEQVYRLPALPFPKHPYRFARPFPTLPLDFSQLQIDIVHCQHPFPVGRLGARLARKNGIPLVYTVHSLYDTMLLLAKPALVRRLGPPTMRNVMRRFCNQADVVIAPSHYVAQALARCGIAVPIQVVPSGVIPPHVTPGDRESVRCQIGISEEVPVLLYVGRLAPEKRVDLLLEAVALLEQRSLKGPQGAFRLLLVGDGPCRAQLEWQVQRLGIQGRVVFVGAQPHAKIGAWYAASDIFLMPSPMETQGLVVIEAMNCGLPCIAVSEGGAGEAVIPEQTGILCPFSASAFATAIEMLLTNPYRRKQMGQNAYRHAEIYAPARTAQNILAAYTQAQAKHKREPI

SEQ ID NO: 8233 - protein, 393 aa, Arthrobacter sp.
MTEEPADKPLTILIACDTYPPHLNGAAQFGFRLAQGMHGRGHNVHVLAPSPESGPSHSETDGLWTVHRLRSHGVPTHEYWRICLPWEIKKHISMLLDRVQPDVVHIQCHYMVGEYTLYEARKRGIRVVATNHFMPENLDPFLPFPKWFKRIVARNSWRDMGKVMGQAAVVTTPTPLAAKAMVEYARLPDVMPLSNGIDASTYEPRPGESIDRPDHPTVLFVGRLAEEKHVDVLIDAVAKTPPELNVHAEIVGGGEVKSALIAQAKRLGIEDRVAFRGLVSDEELRQAYLRADIFCMPGTAELQSLVTLEAMSASTPVLLADAMALPHLVEQGENGYLFEPGNSTEVSKRITEILELSEDERAKMGRHSRAMVDSHSLESTLATFEKLYRAEGI

SEQ ID NO: 8234 - protein, 393 aa, Unknown
  Description of Unknown: Cryobacterium arcticum sequence
MAADTFAPDVNGAARFAERLAAGLVARGHVVQIMAPAATRKHGTWTEVHEGQSMTVHRLHSWRWRPHDWLRFALPWIVRRQSRMILDSFQPDVVHFQSHIVIGRGVAIEAQKRGIRIIGTNHFMPENLLQFSLVPKGFQDHVVKALWKAAEHTLKRAEAVTTPTRRAAEFLEKYTGLSGVRSISCGIDADNYSPNFEPRTENRVLFVGRVTGEKQIDVLVQAIALLDPSLNVQVEIVGGGDQRRNLELLVESLGLADRFTFTGYVTDEELRSAYSRATVLAMPSIAELQSIVTMEAMASGLPVVAANAMALPHLVHDGQNGYLFEPGNAQDLADKLTVVLTSSPEELDALKRESLKLIEAHDIKRTLNTFEMLYRGEPVTDPLVTDTAAQSRD

SEQ ID NO: 8235 - protein, 710 aa, Synechococcus sp.
MGRGVRVLHLHLYGLFRSRDLELGRDADTGGQTLYVLDLVRSLAQRPEVDRVDVVTRLVQDRRVAADYERPLEVIAPGARILRFPFGPKRYLRKEQLWPHLEDLADQLVHHLTQPGHEVDWIHAHYADAGFVGALVSQRLGLPLVFTGHSLGREKQRRLLAGGGDRQQIEQAYAMSRRIEAEEQALTQADLVITSTQQEADLQYARYSQFRRDRVQVIPPGVDAGRFHPVSSAAEGDALDQLLSPFLRDPSKPPLLAISRAVRRKNIPALLEAFGSSSVLRDRHNLVLVLGCREDPRQMEKQQRDVFQQVFDLVDRYDLYGSVAYPKQHRRSQVPAFYRWAVQRGGLFVNPALTEPFGLTLLEAAACGLPMVATDDGGPRDIQARCENGLLVDVIDAGALQEALERAGKDASRWRRWSDNGVEAVSRHFSWDAHVCRYLGLMQAHLHQLPSVGPRPQGSPASSHRPDHLLLLDLDSTLDCPDGPSLTALRSQLERDGQRYGLGILTGRSLAAARQRYGDLHLPSPLVWISRAGSEIHLGEDLQPDHIWAQHIDTDWQRESVEAVMEDLHDLLELQSEEHQGPWKLSYLQRQPDESVLSHVRQRLRREGLSARPQRRCHWYLDVLPRLASRSEAIRHLALHWQLPLERVMVMASQQGDGELLRGLPATVVPADHDPCLVRHPQQKRVLLSGRPSLAAVLDGLSHYRFPSQR

SEQ ID NO: 8236 - protein, 394 aa, Deinococcus sp.
MRALRIGLFTDTFLPDQNGIVTSVGLLSDELRARGHHVDVVAPFFPEQQDTRPDVRRVPSVRYVFLPTYRLAWPTRRAFEAKYDVIHTHTPLTLGLAGARLARKWNVPHVATYHTHVEAYTHYVPGMTLLQRQTRFVTRLMGLYYRRADAVITPTAGMLDVIREMGVRNSVVIPTSVDPAVLRAAPPIANPWPAGARRLLTVGRLAREKRFDLVLDTLARLPGAHLVILGEGPEREHLLQHAERLGVEERVSFLGVRPWTEIGAYYRLAELFLFASDTETQGLVLQEAQLMGVPVVAVGARGTLSGVAHGRSGYLVPPGDVAALTRYAQAILGDAALWKRLSLGARAFGTSWTPGGVAERVLDVYASVLGLPREVPFPLEAGGLSPRSTLAYDR

SEQ ID NO: 8237 - protein, 370 aa, Unknown
  Description of Unknown: Halobacteriales archaeon SW_7_68_16 sequence
MDPAVAAFTDTYLPTVNGVTYTVSCWRDRWHDRGGRMDVVYPDSDEYAPEDGEHPVGSLPFPFYDGFRVAAPSLPGDLDGVDLVHAHTPFSLGLAGLRLARRRDVPFVASYHTPTSEYAEYIAPRGLFDGAIERVISWYERVFFGRADLVVVPTEPVRNHLVGTVGVSTDVRVLSNGVDTERFTPASSAAVERFRERHDLPDGPLVGYTGRHGYEKRLPDLIEAAEGIDDVTVVFGGDGPERDRLRRRARAADVDVRLLGFLDREELSTFYTALDAFAFPSPVETQGLVALEANACGTPVVGVDAGALSHTIDDGETGYHYPPGDLVTFRDRIERALAERERLRETCLARRDRIGVAETVEKLGALYRTL

SEQ ID NO: 8238 - protein, 423 aa, Unknown
  Description of Unknown: Rhizobiales bacterium sequence
MKIAIFTNTYTPHIGGVARSVSGLVEELRATGHAVLVVAPEFAGRPEDEAGVIRVPAIQRFAGSDFSAPVPITLALVRALDAFDPDIVHTHHPFLLGDTALRISASRNLPVVFTYHTRYELYGHYVAQDAPALQRLVLSLALGYCELCDSIIAPSESMEVFLKEHRVAAPITVIPTGIEASRFDHGDGKRIRADLGIAADAFVVGHVGRLAQEKNLGYLADAVGLFLRDRGQSRFVVAGGGDMQGPMREAFARSGLTGRAHLLGPVEGERLSDVYAAMDVFAFSSRSETQGLVLAEAMTAGVPVVALDAPGAREVVVDGENGRLLPADASAGRFAEALEWVAGRPAAERASLGQTARKTAAAYSRPETVRRVLSLYESLLEGHLKAKSLDDSPWAAARRALAREWDILRNIANAVGDAAAGDE

SEQ ID NO: 8239 - protein, 390 aa, Ammonifex degensii
MRVGIFADSYLPYVSGVVRSIETFREELEKRGVIFFLFVPWYPGCQKEPNIYRFWALPAPTNPDFTLPLPFSPRLGSTLRSLKLDLIHVHGPFLMGSLGARWARRLNLPLVFTYHTLYEAYVHYFPFLRSWARTLTRRYTVGFCNRCDLVLAPSLAIKKYLEQNGVKAPVEVLPTGIKLSSFRGGDREAFRLNFNLSLEEKVLVYVGRLGEEKNLRFLLRSFALVKKELEATRLVLVGGGPQKEELEKLARSLGVGQEVIFTGPLPPDKVKDAYAAADLFVIASLTETQGLVVGEAKAAGLPVVGVEANGVKEMVRHGLDGFLTPPDEKAFAAAVIRLLSDEELYRKFKQEALKGAEELSSERQAERLLQLYRQLVAGRDKMHEKDGSKA

SEQ ID NO: 8240 - protein, 394 aa, Unknown
  Description of Unknown: unclassified Rathayibacter sequence
MGCDTFAPNVNGAAKFAERLAAGLAQRGHEVHVVAPSADGWSGTRVETHEGQRIVVHRLFSLRWYPHDWLRFAIPFRIRQNSARILDEVKPDVVHFQSHMIVGRGLSIAAEDRGIRIIGTNHFMPENLLEFTLLPTSVQAKAIQMAWRAASRTFGRAEAVTTPTRKAAQFLEKFTGLKDVQAISCGIDADNYTPDFTTRPGNSILFVGRVTGEKHIDVLLRAVSLLDPSLDAKLEIVGGGDQMRNLQQLATTLGIADRVRFTGYVDDAELKEAYTRASVFAMPSIAELQSIATMEAMASALPVVAADAMALPHLVHDGENGFLFAPGDAQALADRLTDVLTAAPDAFEAMKRASLRIVAAHDINRTISTFESLYRGEPVADPASDAASAPAGRS

SEQ ID NO: 8241 - protein, 432 aa, Haloquadratum walsbyi
MSIPTVVAFTDTYLPTVNGVSYTIQTWRDHWRDRGGTMQIVYPAAEQYDSTTGEFSIHSLPFPLYDGFRLGLPLLPDELDMANIDVVHTHTPFALGLSGVRLARRADVPLIASYHTPTGEYADYLTSRPRVERVVSAIANEYEHWFLSRADAVICPTYDARNRLRSSIDPDAKLTVISNGVDTDFFHPVDKSTTAAFCDKYNLPAGPLIGYTGRHGYEKNLSELLHAAAWIKHKQNGNSSTVESQTTASTEDNAQSTTAGEFDITLHSDDDSRHTQQELIDERNIDSLDVEPTVVFGGDGPAREDLEILADELGLDVHFLGFLSREELPVFYSALDVFMFPSPVETQGLVALEAIACGTPVVGVDAGALSSTIDDGITGRHYQPDNPAACGLKVIEVLTDHERFMNACLNHRSKLSVTRVVDDLLSLYRQMT

SEQ ID NO: 8242 - protein, 403 aa, Unknown
  Description of Unknown: Microbacterium sp. AG1240 sequence
MTSPATPDHVRPDPDRPLTILIGCDTFAPDINGAARFAERLAAGLVVRGHDVHVAAPNTEYRRAAPRTEVVEDQPMTLHRMPSVRWPPHDWLRFVWPWRSKHYARQVLDAVKPDVVHIQSHIVLGRGLAREARKRGIPIVATNHVMAENLLDFTALPAFLNRYILALAWADAKRTFDMTRAVTTPTRNAADFLESTIDLHGVIPISCGIDQANYTADLAPRDANRILFVGRLTTEKGIDVLLKAVAKLDPSLDVSVDLVGGGDQRKNLETLSDQLGIRSRVTFHGHASEADLRALYTRASVFAIASIAELQSIATMEAMASGLPVVAANAVALPHLVHDGENGFLFEPGNDDELAARLTDVLTASPEERLRMQRASLDGVSVHDIGRTLDTFEALYRGEPIPS

SEQ ID NO: 8243 - protein, 946 aa, Unknown
  Description of Unknown: Candidatus Rokubacteria bacterium sequence
MAVPVSEPRESPTVSVLICTKDRRQDVARALASLRAAGVEREGVEIVVVEETARPAPMAGVRYVPLPPEGRGFAHVRNRAVDAAKGSVLVFVDDDCEVAPGWQCHRVRREHPGIPGRRPAVSRRRDRRRRADRVPLDVQLRLSPRGDRGGRRLLRARLARRRGQPGGRAGERALAVPLRARRRRLPRATPASRRDLPLVPAPGAGGGADPAGQGAAARRRHRARARLAVAADGRADGGAGLAAVAGVAHAAGAARRLLRRAAAPLPVRPPLSGPPGRLVADAARPARRRRRRRGGPAARGAGPAATVAEVGRVSGRPGVSVVLITRNEAARIRRCLESVRWADEIVVVDQHSTDGTPAICREYGARVVTRDMLAGFGDQKNFALAQATQPWILSLDADEEVTPALRREIETAVASPGEHAGFRMPRLTSYLGRFIRHCGWYPSPVLRLVRRGRGRFTEALVHEELLVNGPVGDLGADLLHRSYDLLADHVRKLLLYAAYDARMLEQRGDRVGGLGALWRLAVKPPAVFVRKYVAQGGFREGWHGFVLSAMAALVVFVNYVRLAELTGWLPTPAEPGPAGEPPTVLLMANFADLVGGGEESLLALAARLDRHRIRPVASVPAEGDVAERLRALGVPVTVLPLPPVRPWRAAGMAWTLSRLRVLLAGERVALVHAQGGRGALYAALAARGRRTPVVWHARTADADRWLDPILARLAHTIIANSGATACRFRAWPAARVIVVPNGVDLGRFTPGVADPEVRRALGLPAAGPVVGYFGRLEHGKGPDVLLAAGERLQLKVPGVTLLVVGEGPLRAPLARRAAAAGVHAVFAGQRSDVPALLRLCDIVAVPSRQEAFGRILIEAMASRVPVVASAVGGVPEVCADGFTGLLVPPEDPDALAAALAVTLADTAAAAIRVQRAATDVSARFDIHTHAARIHTVYDRVLEDTGQ

SEQ ID NO: 8244 - protein, 550 aa, Cyprinus carpio
LSLSVPSKVMKAFFLLATLLWCLTTSFSWAAKIVVVPPIMFESHLYIFKTLASALHAEGHDTVFLISEGREVPPSNHYRLQRYPGIFNSTSADDFLQSKVHNIFSGRLTALELFDILDHYSQNCDAVVGSASVMEQLKREQFDLLLVDPNEMCGFVIAHILGVQYAVFSTGLWYPAEVGAPAPLSYVPEFNSLLTDRMSLFQRVANTAVYLVSRFGVRFLVLPKYDRIMRKYNIQPSVSMHDLVQNSRLWMLCTDMALEFPRPTLPHVVYVGGILTKPPSPLPQEFEAWVKDTDEHGFVVVSFGAGVKYLSDDIARKLAGALGRLPQRVIWRFSGVPPSNLGNNTKLVDWMPQNDLLGHTNTRAFLSHGGLNSIYEAMYHGVPVVGVPLFGDHYDTMTRVQAKGMGIMLEWKRMSEEDLYTAMVNIITDKRYRERAQLLSQIHKDQPGHPVSRAVYWISYILRHRGADHLRSAVYEIPTYQYFLLDVAVVIGVCLLLLGYLLYRIGKCIQSRMVRGSSPAEKVNGHCHNGIPNGKHKRNGHVRSTEKKLK

SEQ ID NO: 8245 - protein, 280 aa, Carlito syrichta
MGKAEMWLTQTYWDFEFPRPFLPNVDFVGGLHCKSAKVLPKEMEDFVQSSGENGIVVFSLGSMVSGLTEERANVIASTLAQLPQKVLWRFNGKKPHILGPNIRLYKCIPQNDLLGHPKTRAFLTHSGTSGIYEAIYHGSPVVGIPLFADQPDNIAHMVIKGVALRVDFNTMSSTDLLNALKTVINDPIYKENAVRLSRIHHDQPAKPLDRAVFWIEFVMRHKGAKHLWAAVHDLTWFQNHSLDVIGFLLACVATVIYTITKCCLFCFREFAKTRKKEKRE

SEQ ID NO: 8246 - protein, 492 aa, Chaetura pelagica
VWPADNSHWLNMEYILQELVVRGHKVTVLMPSCFLIFNHTQPSPFQFEVVEVPITKKEMDTLLQEFFGFFFYKDRDLSAWETVHKIAQLVYTMKNVIRIISDEVLKNEVLLERLRASAFDVLLADALSPSGELLAEKLGIPFVYTIRFSLGNTLERLCGALPAPPSYVPATLTGLTDRMSFLERLKNIFAYTIQDIIYHTMIWGSWDQYYSDVLGRPTTLCETMGKAEIWLIRTYWDFEFPRPFLPNFEFVGGLHCKPAKPLPKEMEEFVQSSGKHGIVVFSLGSMIYNLTDEKSNVIAKALSQLPQKVLWRYKGKKPETLGSNTRIYDWIPQNDLLGHPLTKAFITHGGTNGIYEAIYHGVPMVGIPLFADQHDNIAHMRAKGAAVELDFSTLKTQDLVDALNTVINNSTYKENALRLSKIHHDQPVKPLDRAVFWIEFVMRHKGAKHLRPAAHNLTWYQYHCLDVLAFLFTCTAITIFILVKCCLFFCRC

SEQ ID NO: 8247 - protein, 530 aa, Otolemur garnettii
MAVKWTSAFLLLQLSCCFSSGTCGKVLVWPTEYSHWINIKTILDELVQRGHEVTVLASSASILVDPSKTSAIKFEVYPTSLTKDDFEGFLFKMFNEWTYDIPKDSFWSYFSQVEKLTWKYSDCIQKLCDDVVFNTKLIKKLHDAKFDVVLADAISPCGELLAEILKTPLVFSLRFSPGYSFEKHSGGLPFPPSYVPVILSELSDRMTFMERVKNMIYMLYFDFWFQTFNMKKWDQFYSDVLGRPTTLYEMMGKAEMWLIRTYWDFEFPRPLLPNVEFVGGLHCKPAKPLPKEIEDFIQSSGENGVVVFSLGSMVSNMKEERANVIAAALAQIPQKVLWRFDGKKPDTLGPNTRLYKWLPQNDLLGHPKTKAFVTHGGTNGMYEAIYHGVPMLGIPLFADQPDNMAHMRAKGAAVTLDFTTMSSADLLSALKMVINDPIYKENAVRLSKIHHDQPMKPLDRAVFWIEFVMRHGGAKHLRVAAHDLSWAQYHSLDVIGFLLACRAAVMFVLTKCCLLCYRKFAAQRKKGKQE

SEQ ID NO: 8248 - protein, 528 aa, Anopheles sinensis
MASGAVVKCFLVLIGCLSASTLAANILYINTVASPSHFGWNRALMYALAGEGHNLTVFGVDSDKKPPPNVTFILIEDVYKKLYSDEEVETDFFEINKMGPFKMLKMYNEYMLGTCKIVLESGGAKQLLEYPADFGFDLIVHDYLSAPCLTALAHHRFGKPPLVAVTAYHAPSTTAYMSGAFQYSALVPNHVYDAMEEMTYCQRFTNFLLNVWEELLQTYDMIPQSNQLLRQYDPTLPDVAEFNRETKVVLLNANPIIQFTEPMMPNVIPVGGLQIIKPKPLPEDLAKILEQAPPGGVVVFSLGTNVRSDTLGVARITAILDAMEALPEYHFIWKFESDSMPRALPPNVHLRKWLPQNDLLAQPKVRLFITHSGLLSTQEAIWHGVPMIGFPVFADQFKNINYCMAKGVGKRLSIEHINTKELVDTIKEVMTKESYRTNMKRMSELFRDQPEHPLDRAVWWIDWVLRHPDSTELLTHGTRLHWFVKYSYDVLVPLLAAIAIVCHFVIFTVRRVFFSRKTTSKGEKQKRS

SEQ ID NO: 8249 - protein, 413 aa, Orycteropus afer
MSAKWISVLLLIQLSCYFDSVTCGKVLVWPTEYSHWINIKTILDELIQRGHEVTVLTSSASILIDPNKSSDIKFEVYPTSLTTPDLEILFMKWIKKMTYNMPKDNFWFQIFNMKKWDQFYSDVLGRDTTLIETMGKAEIWLIRTYWDFEFPRPFLPHFEFVGGLHCKPANPLPKEFEEFVQSSGKHGVVVFTLGSMVRNVTEERANTIASALAQVPQKVLWRFDGKKPDNLGPNTRLYKWLPQNDLLGHPKTKAFITHGGTNGIYEAIYHGIPMVGIPLFADQPDNIAHMKAKGAAVSLDIKTMTSADLLNALNSVINESSYKENAMKLSAIHHDQPVKPLDRAVFWVEFVMRNKGAKHLRPASLSLTWAQYHSLDVLGFLLACVAIVTFLVIKCCSFGYQKFFKTEKKEKKD

SEQ ID NO: 8250 - protein, 445 aa, Erinaceus europaeus
MPMKGISVLLLLQVACYFSSGKCGKVLVWPTEYSHWMNIKTILDELAQRGHEVTVLTSSASILIDPNKKSAIKFETYPTSVSKDEFNNVIMEVIHTWIYKMPKDAFWSHFSILQEQLWKFHVVVYKLCREAVLNKNLMMKLQESKFDLVLSDPVSPCRPTTLHETMKKAEMWLIRTYWDFEFPRPFLPNFEFIGGLHCKPAKSLPKEMEQFVQSSGENGIVVFTLGSMVRNMSEETANMIASGLAQIPQKVLWRFEGKKPDTLGKNTRLYKWLPQNDLLGHPKTKAFITHGGTNGIYEAIYHGVPMVGIPLFADQPDNIAHMKAKGAAVGLNLDTMSSKDLLSALKTVINDPSYKENAMKLSRIQHDQPVKPLDRAVFWIEFVMRHKGAKHLRPAAHDLTWVQYHSLDVIGFLLACVAATVYIITAGCLFCFRKCTKSGKREKRD

SEQ ID NO: 8251 - protein, 490 aa, Drosophila grimshawi
MMTNAIIRELVQRGHEVTFITPFTLANENLGSNYTEVLIPQYNFWPTVLETTKINTVVELTNVPTLKLLKLFYIMGLESTNFAFEQQEVLKLIHAKDKDDKYDLLLVEQFFNEGALFLGHLYQIPVIDIFTFTFANYMSSLVGVVTPWSYVAHGWKPYTDRMSLLERIDNVYCSLTEELMRQFWYYPAQDELLNRHFSKHFDKLPTIKQLERNISVILLNTYMPLEAPRPLSFNMIPVGGLHIKPAQPLPTEMQKFLDEAEHGAVYFSLGSQVKSSEFPPEKLKIFLDVFRSLKQRILWKFEDDKLPNKPANVMVQKWMPQSDILAHPNVKVFISHGGLFGTQEAVYHGVPVLGMPVYADQYLNINKGKVAGYALGVDYRTVTEEELRYSLTELLENPKYRDTMRRTSRIFRDRPLSAMDTAMFWIDYVIEHRGAPHMVSEGINLPWYKFYLLDIIGIALVIIIMPILGLLLICRRFQNAKKSKTKSKRN

SEQ ID NO: 8252 - protein, 528 aa, Carlito syrichta
MMLNNILLLSLQISLLGTVFGENVLIWPMEGSHWLNVKIIIDELIKKEHNVTVLVASGALFITPTANPSLIVEVYTVPFGKERVEGVIKDFVLTWLENRPSPSTIWRFYHEIAKVTKEFHKVSMEICDGVLKNQKLMEKLKKSNFSLLLSDPVFPCGDIIALKLGIPFMYTLRFSPASTVEKHCGKVPYPPSYVPAVLSELTDQMSFADRIRNFISYRLQDYMFETLWNSWDSYYSKALGRPTTLCEIMGKAEIWLIRTYWDFEFPRPYLPNFEFVGGLHCKPAQPLPKEMEEFVQSSGDNGVVVFSLGSMVKNLTEEKANLIALALAQIPQKVIWRYKGKKPVTLGNNTRLYDWIPQNDLLGHPKTKAFITHGGTNGIYEAIYHGVPMVGVPMFADQPDNIVHMKAKGAAVDVNMNTMTSADLLSALRTVIYEPSYKENAIRLSRIHHDQPVKPLDRAVFWIEFVMRHKGAKHLRVAAHDLTWFQYHSLDVIGFLLACVATMIFVITKCCLFSCQKFGKTRKKRKRE

SEQ ID NO: 8253 - protein, 529 aa, Aotus nancymaae
MSVKWTSVLLLIQLSFYFGSGHCGNVLVWAPDFSHWMNMKTILNELVQRGHEVTVLAKPASILVDPNNPSTLKLEVFPTSLTKTELDNIIIQQVKRWSDLPKDNFWSYFSQVQEMAWIFSDIYRNVCKDLVSNKKLMKKLQESRFDVIFADAIFPGGELLAGLLNIPFVYSLSFSIGYTLEKHGGGFLFPPSYVPVVISELSDRMTFMERVKNMIYMLYFDFWFQLFDMKKWDQFYSEVLGRPTTLFETMGKAEMWLFRNYWDFEFPRPILPNVDFVGGLHCKPAKPLPKEMEDFVQSSGENGIVVFSLGSMVSNITEERANVIASALAQIPQKVLWRFAGKKPNTLGSNTRLYKWLPQNDLLGHPKTKAFITHGGANGIYEAIYHGIPMVGIPLFAEQPDNIAHMKAKGAAVGVDFNTMSSTDLLNALKTVINDPFYKQNTMKLSRIHHDQPMKPLDRAVFWIEFVMRHKGAKHLRVAAHDLTWFQYHSLDVIGFLLTCVAAVIFIITKCCLFCFRKFVKTGNKEKKS

SEQ ID NO: 8254 - protein, 528 aa, Equus asinus
MSLKWIPLLLLLQVSCYFSPGSAGKVLVWPTEYSHWINMKTILDELVQRGHEVTVLTASASILVDPNKPSAIKFEIYPASLTKHDYEVIFKTLVDTWTRLPKDSFWTHFTLMQEIIWQFSDNVLKLCNDAVLNKKLIGKLQESKFDLIFADAVGLCSELLAELLQIPLVYSLRFSPGHTIEKYGGGLPFPPSYVPVVMSELSDQMTFMERVKNMIYVIYFDFWFQTFNEKKWDQFYSEVLGRATKLYELMRKAEMWLVRTYWDFEFPRPFLPHFQFIGGYHCKPAKSLPKEMEEFAQSSGENGIVVFTLGSMVSNMTEERANVIASAFAQIPQKVIWRYDGKKPDTLGPNTRLYKWIPQNDLLGHPKTKAFITHGGANGIYEAIYHGIPVVGIPLFADQPDNVAHMKTKGAAVRLDFDTMTSSDLLNALKTVIHDPSYKDNAMKLSRIQHDQPMKPLDRAVFWIEFVMRHKGAKHLRPASHDLTWFQYHSLDVIGFLLACVATTVFVIIKCLLCCWKFAKTGKKEKRE

SEQ ID NO: 8255 - protein, 509 aa, Tribolium castaneum
MWSKVILFVFFVNYGNSANILGLYFHAGKSHHILGEMLLKELARRGHNVTMASPFPLKEPFPNYTDIHLTGILEDQIARESMFMKMNKGHALVGVNDVLELTRAQTELTLNHTEMAKLLKSGTKFDVIIIDWFMNGAILMYGKLFNAPIIPIASHGTTHLANYIVGNPAPPSYIPNAMLPFPPNMTFFQRMVNGLVTIAYNVVGHTNAKYHQALLEKYFENAPSLDELKDTVALVLSNGHYSFESPRPFVPNVIPVGGFHVQKARKLPTDLQKYMDEAKHGVVYFSLGSNMKSVLLPKEKQQQILKAFAKIPHKVLWKWEDDNLENKPDNVLIRKWFPQNDILGHPNLKLFITHGGLLSTIEALHHGVPVLGIPIFGDQKANIPNAVSSGYAVQLELADLDEATLTKALDEILTNPKYQENAKKRSQLLHDQPMSPMDTAVFWVEHVIRHKGAPHLRNLGSYLPWYQYLMLDVALFVVLFLLVVVGIVGFVIRKICGCCCQRKSKEKRE

SEQ ID NO: 8256 - protein, 530 aa, Ochotona princeps
MSMKCASVLLLLQLNCCIHSVSCGKVLVWPMEYSHWLNLRTILNELIQRGHEITVLTSSPYIFFDPSKELGMKFANFPTSFTKEEIDDFFKYWINVLLNDMSRYKYWDYFPRWQKFFLKHSAIFDKLCKELVLNKEVMKNLLASRFDVIVADAVVPCGELLAELLEIPLVYSLRFTPGYKYEKYCAGLHFPPSYVPVIMSTLSGNMTFMERVKNILWMLYFDFWFQTFNDRALDKFYSEVLGRPVTFTELVGKADLWLIRSYWDLEFPRPLLPNVKFVGGLHCKPAKPLPKEMEDFVQSSGEHGVVVFSLGSIVTDMTEERTNVMAAALAQLPQKVLWRFEGKKPASLGTNTRIYKWLPQNDLLGHPKTKAFVTHGGANGIYEAIHHGIPMVGLPLFGEQPDNVAHMTAKGAALTLNWRTMSSTELFNALRTVINDPFYKENVMKLSRIHHDQPMKPLDRAVFWIEYVMRHKGAKHLRVAAHDLTWYQYYSLDVIGFLLACVTIIIYLVIKLCLFAFQKVVNTGKKTKRD

SEQ ID NO: 8257 - protein, 529 aa, Dipodomys ordii
MSLKWMSLLLLIQVMYCFNAGSCGKVVVLPMEYSHWLNVKIILDELVQRGHEVTVLTSSASILVNSGKSSPFKFEIFPTSLTTEEFASLFKRCVNVWTYEFPKYSVWKFYSRMQSMFEEYSDVFEIFCKYMVFNEELMKRLQESKFDALLTDPVVPCGELLAELLKIPLVYTLRFFPGNEYEKQCGGLPFPPSYVPVALSELSDRMSFMERVKNMMNVIFFDLYFQTFNEKKWNQFYSEVLGRPTTILELMAKADIWLIRTYWDLDFPRPLLPNFEFVGGLHCKPAKPLPEEMEKFVQSSGDQGVVVFSLGSMVSNLTEERANTIASALAQIPQKVLWRYEDTTPKTLGSNTRLYKWIPQNDLLGHPKTKAFITHGGTNGVYEAIYHGVPMVGIPLFVDQPDNIARMKAKGAAVRLDFTRFSSEDLLNALKTVIYNPSYKENAMRLSRIQHDQPVKPLDRAVFWVEFVMRHKGAKHLRPAVHDLNWFQYHALDVIGFLLACVAALIFIFTKCCLFCCRKFPKSGKKKRE

SEQ ID NO: 8258 - protein, 446 aa, Fukomys damarensis
MSMAWISALLLLQLSCYFNSGSCGKVLVWPMEYSHWMSMKNIIEELIQRGHEVTVLRPSSFIFVDVNSSSGIKFETFPSSVSREQLEEFYSQLLTKLINIGSIDSCLFCFLNSDDFSKAFSDNVHFFCKEAVSNKKLMTKLHESRFDVLLADPIAPCGKRTTLYETMAKAEMWLIRSYWDLEFPRPSLPNFDFVGGLHCKPAKPLPKEMEDFVQSSGEHGVVVFSLGSMISSMTEERANAIASALAQIPQKVLWRFDGNKPDTLGPNTQLYKWLPQNDLLGHPKTRAFVTHGGANGVYEAIYHGIPMVGIPLFGEQYDNIANMVAKGAAVKVNFITITSTELLNALKTVLNSPFYKENAMWLSTIHHDQPMKPLDRAAFWIEFVMRHKGAKHLRPLAQNLTWYQYHSLDVIGFLLAGVVIITFLVIKCCLICSRNFVKMVKKQKRE

SEQ ID NO: 8259 - protein, 528 aa, Aedes aegypti
MRSKAVVALLLLSILCLSGVSCEKVLFLIPFPGSSHWLMFKHFIRELTERGHEVTAVTSYKFGEAIDNYTEVLIDPSYPILEKLTILPVPISAVYSSQDYQNDFKNLLLYWRLGLETSRYALESANVQKFIKREDQHFDLIVAEQFFQESLLMFAHKFDAPIITISTIGYSDYMDRAMGLLTPWSFVPHMLLDCDDQMSFYQRAYNVLLSTVDYIGRELYYLPQQNKLAMEIFDRFVDHHGPLPTVQSLEKSISAMLVNSHQTLAKPRPSMVGIANIAGAHIKPPKPLPQDLQKFMDEAEHGVIYFSLGAYLQSSLMPLEKRSILLNVFAKLQQRVIWKYESGDLTDVPDNVLIRRWAPQNDILAHKNVILFISHGGLFGTFESMHHGVPTLFIPFFADQPRNAARGVRSGYARKLSFKDITEDSLFENIREMVQNKEYSTRAQEISVIFRDRLVDPMNESIFWMEYVMRNKGARHLKSQAVNLSLVQYLLLDIVASVLVAGVVFEMVLKVCCLCRKQKDTRYKKKQN

SEQ ID NO: 8260 - protein, 450 aa, Condylura cristata
MSLQWTSVLLLLRMSCYFSFGSCGKLLVWPTEYSHWISMKTILDELAERGHEVVALTPTTSIQMDSSKPSAIKFEVVPSSLKKEDWEHHVGQLLSLWTNDTAKDVPWRYLQKIKELFWKSFDLAEIGCKDVILNKDIMAKLTQESGFDLILADAYFVSFLPSGKPTTLFELMGKAEMWLIRDYWNFGYPHPLLPNFEFVGGFHCKPAKPLPKEMEEFAQSSGENGIVVFSLGSMISNLPEERANVIASALAQIPQKVLWRFDGKKPATLGANTRLYKWLPQNDLLGHPKTKAFITHGGANGIFEAIYHGVPMVGIPLFVDQPENMAHMKVKGAAVVLDIQRMSSTDLLNALKTVINDPSYKENVMKLSRIQHDQPMKPLDRAVFWIEFVMRNKGAKHLRPASHDLTWAQLHSLDVIGFLLACVATAVYGITKCCLFCCRKVVKTRKDKRE

SEQ ID NO: 8261 - protein, 538 aa, Tupaia chinensis
MRSEKWAAAMLLLQLCFAGCGFCGKVLVWPCDMSHWLNLKIVLEELTKKGHEVTVLVSSQSFLIDYSKPSAINFEVLPGSLDRETYLRQLNSFLDLAVNVMPTLSRLQSAKKLQEFMAEVTVRHKVFCESVTSNHSLMMKLQETKYDVMVIDPALPCGELVAEWLALPFVYTLRLSMGGTLEKYCGQLPSPPSYVPVPMGELTDRMTFMEKMKNMLLKRVKNMLLTFFFDIWIKQYDNWLWDQFYSEVLGRPTTLCEIMGKAEIWLIRTYWDFEFPRPYLPNFEFVGGLHCNHSKPLPKEMEEFVQSSGEDGIVVFSLGSMVKNLTDEKANIIASALAQIPQKVLWRYKGNKPAALGANTRLYDWIPQNDLLGHPKTKAFITHGGTNGIYEAIYHGVPMVGIPMFADQPDNIAHMKAKGAAVDVNMNTMTSADLLNALKTVINEPSYKENAMRLSSIHHDQPVKPLDRAVFWIEFVMRHKGAKHLRVAAHDLTWFQYHSLDVIGFLLACIISAMFLVTKCCLFFYKKFHKTEKKKKRE

SEQ ID NO: 8262 - protein, 530 aa, Ochotona princeps
MSRKCISVLLLLLQLSCCFRSGSGGKVLVWPMEYSHWMNLNVILDELVRRGHEVIVLRNSASIFLDPSKHTGIKFETFPVSFTKNDLENFFTQWVTNWTETDKDSYWKYLLALQDIFGVYSGLYEILCKEAVLNKQLMAKLQEAKFDVILSDAIGPCGELLAELLQTPFVYSLRFSPAYTMEKYSGGLISPPSYVPLILSDLSGKLTFMERVKNMLSMLYFDLWFQIFNEKQWDQLCSEVLGRPVKFYDLVGKADMWLIRSYWDLEFPRPTLPNVHFVGGLHCKPAKPLPKDMEDFVQSSGEEGVVVFSLGSMVGNGTEERANVIASALARLPQKVLWRFDGKDPKSLGPNTRIFKWIPQNDLLGHPKTRAFVTHGGANGIYEAIHHGIPMVGIPLFGEQPDNIAHMTAKGAAVRLNWKTMSSADLLNALRTVINDPSYKENIMTLSRIHHDQPMKPLDRAVFWIEHVMRHKGAKHLRVAAHDLTWYQYHSLDVIGFLLACVTIISFLIIKTCLFICQKFADIGRKKKRD

SEQ ID NO: 8263 - protein, 238 aa, Ursus maritimus
MEEFVQSSGENGIVVFTLGSMIKTMPEERANTIASALAQIPQKVLWRFDGKKPDTLGPNTRLYKWIPQNDLLGHPKTKAFITHGGANGIYEAIYHGIPMVGIPLFADQPDNIAHMKAKGAAVSLDFHTMSSTDLLNALRMVINDTSYKENAMTLSRIHHDQPIKPLDRAVFWIEFVMRHKGAKHLRPASHDLTWFQYHSLDVIGFLLACVATAVFVTTQCCLFCYRKCAKRGKKEKKE

SEQ ID NO: 8264 - protein, 361 aa, Ovis aries
MYSLYSTPGSSVEKKSGRLPFPPSYVPVMLSELSDHMTFMERVKNMIYALYFEFWFQAYNEKKWNQFYSEVLGRPTTLVETMGKAEMWLIRNYWDFSFPRPRLPNFEFVGGIHCKPAKSLPKEMEEFVQSSGEHGIVVFSLGSMVSNMSEERANVIASALAQIPQKVLWRYDGKKPDTLGLNTQLYKWLPQNDLLGHPKTKAFVTHGGSNGVYEAIYHGVPMVGLPLFADQPHNIVHMKAKGAAVRLDLETMSTEDLLNALKEVINNPSYKQNVMRLSAIHHDRPVKPLDLAVFWIEFVMRHKGAKHLRPAIHNLTWLQYHSLDVIGFLLACVATAAFVVTKCCLFCYRKFAGKGKKGKRD

SEQ ID NO: 8265 - protein, 526 aa, Geospiza fortis
MAGKEVAVLVLLAVLGWGSGGKVLVWPADNSHWLNMEHILQELVARGHEVTVLLPSCFLIVNPTKPSPFQFEVMQVPFSQETLDAFMEDFLNFWMNEAFNLFPWEIMWTMKEQLEVFTNMSKQTCDTLVMNSRLLAKLQQAKFNVLIADPLSVGGELVAEMLEIPFVYSFRFSEGNVVERLCGGLPSPPSYVPASTMGLTHHMSFMERLQNLLFYIFTDLFFMKFWRDEWDGYYSNVLGRPTTLCETMGKAEIWLIRTYWDFEFPRPFLPNFEFVGGLHCQPAKPLPKEMEEFVQSSGEHGVIVFTLGSMVHSLSDEKSNVIAKALSQLPQKVLWRYKGKKPETLGSNTRIFDWIPQNDLLGHPLTKAFITHGGTNGLYEAIYHGIPMVGIPMFADQHDNLAHMVAKGAAVQVDFNTMKTQDLVDALKTVIYNSTYKENALKLSKIQHDQPVKPLDRAVFWIEFVMRHKGAKHLRPAAHHLTWYQYHSLDVLAFLFTCTATIVFILFKCCLCCCRRCGRIAKRKTE

SEQ ID NO: 8266 - protein, 531 aa, Oryctolagus cuniculus
MSVKYVSILLLLLQLSCCFSSGSCGKVLVWPMEFSHWMNMKTILDALVQRGHAVTVLRSSASILVNSNDESGITFETFPTTSTKDEMEAFFMYWLNKLTNDVSKDALWEYFQTWQKFFMEYSDNYENICKDLVLNKKIMAKLQESRFDVVLADPIAPCGELLAELLNRPLVYSVRFTPGYTYEKYSGGLLFPPSYVPVIMSDLSGQMTFMERVKNMLWMLYFDFWFQMLNVKRWDQFCSEVLGRPVTFSELVGKAEIWLIRSYWDLEFPRPLLPNSYFVGGLHCKPAQPLPKEMEEFVQSSGEEGVVVFSLGSMISNLTEERANVIASTLAQLPQKVLWKFDGKKPDNLGTNTQLYKWIPQNDLLGHPKTKAFITHGGANGVFEAIYHGIPMVGLPLFADQHDNLAHMRAKGAAIRLDWKTMSSSDFLNALKTVINDPSYKEKAMTLSRIHHDQPMKPLDQAIFWIEFVMRHKGAKHLRVAAHDLTWFQYHSLDVIGFLLACLTITTYLVIKCWLLVYQNILMTGKKKKRD

SEQ ID NO: 8267 - protein, 482 aa, Cricetulus griseus
MTAALLLLQLSGLFGSGNGGNVLVWPMEYSHWLNLRAILDELVKKGHEVTVLIPSASLSYEVEDTSAIEFETYPSSYSTADVEKLFMESIRKQINEMPKKSFWRYFLMLQEVVWLYSDYFESLCKDVVFNKELMTKLQTSSFDVILADPFIPCSDLLAEILKTPLVFSLRFFPGSTYEKYSGGLPLPPSYVPPAMSEMGDQMTFMERVQNVLYVLFFDFWFQTFNEKKWNQLYTEVLGRPTTLLEIMGKADIWLIRTYWDLEFPHPVLPNFDFVGGLHCRPAKPLPKVLWRFEGKKPDTLGSNTRLYKWIPQNDLLGHPKTRVFITHGGTNGLYEAIFHGIPMIGIPLFGDQFDNVVHMKIKGAGVRLDFLTMSSTDLFNAVKTVTTDPSYKENAMRLSRIHHDQPVKPLDRAVFWVEYVMRNKGAKHLRVAAHDLTWFQYHSLDVLGFLLACVVTVIFIITKCCLFCCQKFAKGGKKKKRE

SEQ ID NO: 8268 - protein, 532 aa, Lingula anatina
MLQKKTVTTMAMAKTSLTLIIATVCMFLENVNGSKILLYPYAHVYNSRLLNMMKIGQMMFARNHSVTMLVAGNVGPVLDKVPKEIHVKKINLTIPPFNLSGEMLIHKVRTNAFYFVPQWLDYAKEMMDALFGDKTLLGELRSEKYDLMFLDIIAPEGLLLMDYLNIPSVGYSNFGLDNNWDVSPPNNPSYMPNALSAFSEQMTFWERLVNTVSITAMNLMKKWTMTPCYEAKVKYNLNTSLSIESAYTRLSLLIVNSDFVFDYPRPVFPWVKPVSGVLFHPPKPLPKELDQFVESSGDAGFVILSFGTLIPELTAETAAMVARVFARLPQKVIWRNTITNISGLGHNTKVLPWIPQNDLLGHPKARLFITHCGVSSSHEVLYHGVPVVAVPLFVDQFGHARKLVERLGMGEELDFFNFTESAFSGTVLNVLNNPKYFKNAKRAAATVRDQPMDGKEALMFWVEYAIRNNGSLHFHSQGMERLSWYQYLLLDVVGVLFSTVVTVVALIYFSCKAIYRYISKIWPLSKRKNKTE

SEQ ID NO: 8269 - protein, 448 aa, Bos mutus
MHKMSMQWLSLLLLLQLTCYFNSGSCGKVLVWPMEYSHWMNMKTILDELVTRGHEVTVLTPSVTTFIDPKKPSSLKLETFPPSLTKEESENFVKLFVEAWMHAVRDSFWNHLSMVQSLFWGYSDILMKMCKEVVSNKKLMTKLHEERFDVIFADAVGPCGRPTTLVETMGKAEMWLIRNYWDFSFPRPRLPNFEFVGGLHCKPAKSLPKEMEEFVQSSGENGIVVFSLGSMVSNMSKERANVIASALAQIPQKVLWRYDGKKPDTLGPNTQLYKWIPQNDLLGHPKTKAFVTHGGSNGIYEAIYHGIPIVGLPLFADQPHNIVHMKAKGAAVRLDLETMSTEDLLNALKEVINNPSYKENMMRLSAIHHDRPVKPLDLAVFWIEFVMRHKGAKHLRPAVHNLTWLQYHSLDVIGFLLACVATGAFVITKCCLFCYQKFAGKGKKGKKD

SEQ ID NO: 8270 - protein, 529 aa, Carlito syrichta
MSMKWVSVPLLIQLSCYFSSGSCGKVLVWPTEYSHWLNMKTILDELVQRGHEVTVLASSISILVDPNKSSTIKFEVYPTSLTKNDYKNTITRVINLWTHAPKDTFWSFFSQVQEIMWDFSNVFKKLCEDTVLNKKLMRKLQEARFDVLLADTIGPGGELLAELLKIPFVYSLRFSPGYVLEKYGGGLLFPPSYVPIILSELSDQMTFMERIKNMIYVLYFGFWFQTFDMMKWDQFYSEVLGRPTTLLETMGKAEMWPIRTYWDFEYPRPLLPNFDFVGGLHCKPAKALSKEMEDFVQSSGENGIVVFSLGSMVSDMTEERVNVIASALAQIPQKVLWRFNGKKPDTLGPNTRLYKWIPQNDLLGHPKTKAFITHGGTNGIYEAIYHGIPMVGLPLFADQPDNMAHMKTKGVAISLDYHTMSSTDLLNAVKTVIHNPLYKENAMKLSEIQHDQPMKPLDRAAFWIEFVMRHKGAKHLRVAAHDLNWFQYYSLDVIGFLLACVATVIFTVTKCCLFFFQKFAKTERKGKKD

SEQ ID NO: 8271 - protein, 529 aa, Chrysochloris asiatica
MSVKWVPLLLVIQLSCYFSSGRCGKVLVWPTEYSHWINIKTILDELIQRGHEVTVLTSAASVLINPNMASAIKFEVYPTSFNKEEIEISFMSWINEWTRKSKESPWKHFPEIQKIFWEYSDYLERLCKDVVYNKKLMMKLQESRFDVILADAVGPCGELLAQIFKIPFLYSIRFTTGYKYEKYSGGLLAPPSYVPVVMSELSDQMTFMERIKNMIYTLYFDFWFQTFNEKKWDQFYSEVLGKPTTLSETMGKAEIWLIRTYWDFDFPRPFLPHFDFVGGLHCKPARPLPKEMEEFVQSSGKHGIVVFTLGSMVRNITEEKARMIASALAQIPQKVLWRFDGKKPDTLGSNTRLYKWLPQNDLLGHPKTKAFITHGGTNGIYEAIYHGIPLVGIPLFADQPDNIAHMKTKGAAVSLNIDTMTSTDLLNALKTVINDPFYKENAMRLSAIHHDQPVKPLDRAVFWIEFIMRHKGAKHLRPASHDLTWYQYYSLDVIGFLLACVAIVTFVIIKCCLFSYKKLFKRGKKKKRE

SEQ ID NO: 8272 - protein, 445 aa, Bos taurus
MSMKWLLLLQLLQLTCYFSSGNCGKVLVWPVEFSHWMNMKTILDELVMRGHEVTVLQSSASTLIDPNKPLAMKFETFPVSLTKDDFQTLAKILIETWMLAVKDFFWIHLSTIQSLFDEFSDIGMKICSEVVSNKKLMTKLQESRFDVVLADAVGPCGEPTTMAELMGKAEMWLIRNYWDFSFPRPRLPNVEFVGGLHCKPAKPLPKEMEEFVQSSGEHGIVVFSLGSMVSNISEERANVIASALAQIPQKVLWRYDGKKPDALGPNTWLFKWIPQNDLLGHPKTKAFITHGGSNGIYEAIYHGIPMVGLPLFADQPHNIVHMTAKGAAIRLDLETMSTEDLLNALKEVINNPFYKENIMRLSAIQHDQPMKPLDRAIFWIEFVMRHKGAKHLRPASHNLTWFQYHSLDVIGFLLACVTTVVFVITKCCLFCCRKFASIGKKRKRD

SEQ ID NO: 8273 - protein, 446 aa, Orycteropus afer
MSAKWISVLLLIQLSCYFDSVTCGKVLVWPTEYSHWINIKTILDELIQRGHEVTVLTSSASILIDPNKSSDIKFEVYPTSLTTPDLEILFMKWIKKMTYNMPKDTFWAYFSRLQEIFWEYSDCIERLCKDVVFNKELMIKLEESRFDVVLADAIGPCGRDTTLIETMGKAEIWLIRTYWDFEFPRPFLPHFEFVGGLHCKPANPLPKEFEEFVQSSGKHGVVVFTLGSMVRNVTEERANTIASALAQVPQKVLWRFDGKKPDNLGPNTRLYKWLPQNDLLGHPKTKAFITHGGTNGIYEAIYHGIPMVGIPLFADQPDNIAHMKAKGAAVSLDIKTMTSADLLNALNSVINESSYKENAMKLSAIHHDQPVKPLDRAVFWVEFVMRNKGAKHLRPASLSLTWAQYHSLDVLGFLLACVAIVTFLVIKCCSFGYQKFFKTEKKEKKD

SEQ ID NO: 8274 - protein, 524 aa, Lingula anatina
MRIATTALWCVAVLVVSTQVEDISSSKILLIPYIHQQTSRLMNMVKIGQMLSEHNHDVAMLLPSNCVPKNVPEKVRTITFKLDTFPFEISEETFLHEMRKDPFVFMSGWIEYSRDLLDSLFNDSGVMLKMVSEEFDLVFMDVISPQGLIVRDYLDIPGVGYSNLGFGNDRYFSSPLNPSYVPSPTGKFSDRMDFWERLTNALSILGARYVTGKMRVPFSEAKLKYNLNTSLSLWEAQTRLSLVIVNVDFVFDYPRPVMPWVKPVSGLLFHPAKPLPEELERFVQSSGEHGIIIMSFGTMIAGFSSETMAMIARVFARLPQKVILRNAKSNVQGLGNNTKVLPWIPQNDLLGHEKARLFITHCGVSSSHEALFHGVPVIAVPLFFDQFSHAKKLVQRIGMGEELDFYNLTEQAFEAKIKSVLTNPSYYESAKRASALVRDQPMNGKEMMRFWIEYVIRNKGTMHFHSQAMERLNWFQYLLLDVMGFIIITTFCGLIVIWIICKFVLCSLVPKIYRRKPDVKTKGE

SEQ ID NO: 8275 - protein, 331 aa, Mandrillus leucophaeus
MSELRDQMTFMERVQNMIYTVYFDFWFQVWDIKNWDQFYSKVLGRPTTLFEIMAKAEIWLIRNYWDFQFPHPLLPNVEFVGGLHCKPAKPLPKEMEEFVQSSGDNGVVVFSLGSMVSNMSEERANVIASALAKIPQKVLWRFDGNKPDTLGINTQLYKWLPQNDLLGHPKTRAFITHGGANGIYEAIYHGIPMVGVPLFADQPDNIAHMKAKGAAVSLNFNAMSSTDLLNALKTVINDPLYKENAMKLSRIHHDQPVKPLDRAVFWIEFVMRHKGAKHLRVAAHDLTWFQYHSLDVIGFLLACVATVIFIITKCLFCVWKFVRTGKKGKRD

SEQ ID NO: 8276 - protein, 545 aa, Poecilia latipinna
MLLPSSLLLILSFLTWSPSATRAGKIIVVPPIMFESHLYIFKTLATALHPEGHETHFLVSEGREVPPSPHYHLQRYPGIFNSTTADNFLQSKVSNIFSGRLTFLELFDILDHYSQNCDAVVGNGEVMNRLKEAKFDLLLVDPNEMCGFVIAHILGVQYAVFSTGLWYPAEVGAPAPLSYVPEFNSLLTDRMSLMQRIANTGVYLAQRFGVHYIVLPKYDRIMKKHGVKPYAAMADLVQGSRLWMLCTDMALEFPRPTLPHVVYIGGILTKPPSPLPQSFQALVNDTAEHGFVVVSFGAGVKYLSQDIAHKLAGALARLPQRVIWRFSGVAPSNLGNNTKLVDWMPQNDLLGHPHTKAFLSHGGLNSIYEAMYHGVPVVGVPLFGDHYDTMTRVAAKGMGVMLHWKDMTEKDLYASLSSVINDPRYRQQARLLSNIHKDQPGHPVTRAVYWIGYILRHSGANHLRSAVYEVPPYQYFLVDVLLAVAAAGALIVFLLHRLVRLLRGKAGDHSRRVDGSMTNGHCHSESIANGKHKRNGSLKSEKKIN

SEQ ID NO: 8277 - protein, 410 aa, Camelus bactrianus
MKTVKGFCVLFMLHLGFFDSGRTGKVLVWPADFSHWINIKVILEELHRRGHEITVLVPSPSLLLDHTKIPFNVEIFQLPVTKETLREELDTNIYTVSFELPKLSWWDILCDKWDAYYSKVLGKPTTLCETMGKAEMWLIRTYWDFEFPQPYLPNVEFVGGLHCKPAKPLPKELEELVQSSGEDGVVVFSLGSMVKNITEEKANMIASALAQIPQKVLWRYTGKKPDTLGANTQLYEWIPQNDLLGHPKTRAFITHSGTNGVYEAIYHGVPMVGIPLFGDQHDNIARVKVKGAAVEVDLHTMTSSDLLNALKEVINNPFYKENAMKLSRIHHDQPVKPLDRAVFWIEFVMRHKGAKHLRPALHNLSWYQHHSLDVIGFLLACVATIIFLVTKCCLFCCSRFGKTTKKKKRE

SEQ ID NO: 8278 - protein, 445 aa, Miniopterus natalensis
MAMKWIFILLLLQLSCHVRPGWCGKVLVWPTEYSHWMNMKTILDELVQRGHEVTVLTSSASILVDPNKPSAINFEIYPTSLTKDDFEHIFMQVLSKWIYIPDDTFFSYFSQMQDMLWELYISFRKLCKDVALNKKLMTKLQETRFDVILADPFGPCGRPTTLFELMSKAEMWLIRTYWDFEFPRPFLPHFVFVGGLHCKPAKPLPKEMEEFAQSSGQNGIVVFTLGSMVSNISEERANVIASALAQIPQKVLWRFNGKKPDTLGPNTRLYKWIPQNDLLGHPKTKAFITHGGTNGIYEAIYHGVPMVGIPMFADQPDNIARMQTKGAAVRLDFNTMSSADLLNALKTVINDPSYKENAMRLSRIQHDQPMKPLDRAVFWIEFVMRHKGAKHLRPASHDLTWFQYHSLDVIGFLLACVATAIFVITKCVLFCCQKCANPGKKGKRE

SEQ ID NO: 8279 - protein, 530 aa, Cavia porcellus
MSMKWISALLIPQFLCSFNIGSCGNVLVWPMEYSHWMNMKIIVEELIQRRHEVTVLIPSSFIFVGVNASSGVKFETFPTSLRRDQLEEFYTRMISNWMDIGSITTCLSYFPVMEEMLKEYSANWEIVCKDVVSNKNLVTKLQESNFDVLLADPVAPCGELVAELLKLPFVYSLRFSPGFQLEKSAGGLPFPPSYIPVLMSRLSGEMTFMERVKNMICMLYFDFWIEVFNQKNWNKLYSETLGKPTTFYEQMQKADMWLIRSYWDLEFPRPTLPNFEFVGGLHCKPAKPLPKEMENFVQSSGDHGIVVFSLGSMVSDMSEATANAIASALGQIPQKVIWRFDGKKPDTLGANTQLLKWIPQNDLLGHSKTRAFITHGGANGVYEAIYHGIPMVGIPLFAEQHDNIVYMEAKGAAIKLDFHTISTTDLLNALKKVINNPSYKHNAMRLSSIQRDQPMRPLDRAVFWIEFVMRHKGAKHLRPLAQNLTWYQYHSLDVIGFLLACAAIITFVPIKCCLFCFQKFVKTGKKKKRE

SEQ ID NO: 8280 - protein, 445 aa, Mandrillus leucophaeus
MSVKWTSVILLIQLSFYFSSGSCGKVLVWAAEYSHWMNMKTILEELVQRGHEVTALASSASIVFDPNNSSALKIEVFPTSLTKTEFGNIVTQEVKRWIDLPKDTFWLYFSQTQEIMWKFGDISINFCKDVVSNKKLMKKLQESRFDVVLADPIFPCRRPTTLSETMGKADIWLIRNSWNFQFPHPLLPNVDFIGGLLCKPAKPLPKEMEEFVQSSGENGVVVFTLGSVVTNMKEERANVIASALAQIPQKVLWRFDGNKPDTLGLNTRLYKWIPQNDLLGHPKTRAFITHGGANGIYEAIYHGVPMVGIPLFADQPDNIAHMKARGAAVRLDFHTMSSTDLVNALKTVINDPLYKENVMKLSRIQHDQPVKPLDRAVFWIEFVMRHKGAKHLRPAAHDLTWFQYHSLDVIGFLLACVATVIFIIMKCFLFCFWKFAGKGKKRKSD

SEQ ID NO: 8281 - protein, 473 aa, Trichoplax adhaerens
MGGSHVLTMDIITQQLIERGHETVTIISNQPGQLRKMKPSPTVLYNVENPIIAGQRAANVTKLSLIGLVQSLFEIQRQYCEATLANDTLVRLLDDVDIFVTDSLYICGVLVPEMLQKPNIIISLGADIIGYHTFLADYADSTYIPMLGFFHSTKLTMIQRAFNAAIKQFLLITYSYMSSNLMNSLRYKFNISTQSSHYRIKRNPSLFLAACDFALEYPRPLPPNIKVIGPLSPRPSSSLSKELEDYMQASDNGIIVLSLGTELQLPKVKATEMLKALAQIPYRVLWKGNQPEETISDNVKVIKWMPQNDILGHNKTVGFITHCGANGLYEAAYHGVPMIGMPSMIEQKGNAGRMVSAGIGVLINYHQFQAKDIVKAVQEITTNGRYKENVMKVSRILKSRPRAPRDVVVDWVEYVANTNGAHHLKVKGEELWLYEYYNLDVCLFIAMIMYFIYLMMRVCKNMMLGKQSKLKDD

SEQ ID NO: 8282 - protein, 530 aa, Oryctolagus cuniculus
MSTKWISVLLLLQLSCYFSSGRCGKVLVWPVDYSHWINIKTILDELAQRGHEVTVLKPSVSVLLDSNKSLGIKFEIFPTSISKDEYEMVFTEELMNFVLELPKYPFWKYFSKLQEMSMEESDFSENICRDAVLNKTLVTKLKESRFDVILADALCPCGELLAELLEVPFLYTHRVFPGYTYEKYSGGLLFPPSYVPVIMSQLTDKMTFMERVKNMLYVLYFDFWFQTFNEKKWDRFYSEVLGRPTKLTELMGKADMWLIRTYWDVEFPRPLLPNVEFIGGLHCRPAKPLPKEMEDFVQSSGEEGVVVFSLGSMISNLPEERANVIASALARLPQKVLWRFNGKKPDTLGPNTQLYKWIPQNDLLGHPKTKAFITHGGTNGVYEAIHHGVPMVGLPLFGDQFDNIVHMEAKGAAIKLDIITMSSSDLLNALDTVIYDPSYKENAMRLSRIHHDQPTKPLDRAVFWIEYVMRHKGAKHLRVAAHDLTWYQYYCLDVIGFLLVCVATAMFIIIKCCLFCYWKFVKTVKKSKRE

SEQ ID NO: 8283 - protein, 528 aa, Tupaia chinensis
MKWTSTLLLLQLTCCFSFGSSGKVLVWPTEYSHWINMKIILNELTQRGHEVTVLTSSASILVNPNEKSTIKFEVYPTATTKDNFEILFMQMINKWIYDIPRDTFFEYFKQAQEVLWAYFGHIQKLCKEVVLNTKLMTKLQESRYDVILADPIGPCGELLAELLKIPFVYSLRFSFGSTWEKYSGAVPFPPSYVPVVMSELTDQMTFMERVKNMIYVLYFDFWFQSLDEKNWDQFYSEILGRPTTLSEIMGKADIWLIRTYWDLEFPRPLLPNFDFVGGLHCKPAKPLPKEMEDFVQSSGENGVVVFSLGSIVSNMTEDRANVIASALAQIPQKVVWRFDGKKPATLGSNTRLYKWIPQNDLLGHPKTKAFITHCGTNGIYEAIYHGIPMVGIPLFGDQPQNIAHLKAKGVAVRVDFNTMSSTDLLNALKTVITDPSYKENAMKLSRIQHDQPIKPLDRAVFWIEFVMRHKGAKHLRPAALDLNWFQYHSLDVIGFLLACAATVIFIILKCCLFCCRLFTKKGKKEKRQ

SEQ ID NO: 8284 - protein, 521 aa, Capitella teleta
MKLLYLFMLLGFCREERFLLASMQMLSHVKKVVHIEKSLVQRGHHVYVILADDHPLNEQMRQKQGFQVLTYERRSETPSIYSQAMVERLKQIVFNSNLIEDGKFFFEMSSACMEECKVMMQDQRLMHQLKEIGFTMAVIDGFPLAPCHVVLPFYLNIPFVLETGAFGMERPSKSPVMASFQPHPMWSISPQNMVFWQRIVNSLLHFFMPFDYSVPVPALSDMSLIDKYAPQFSSWKELIEQAELFITTRDHLLDWPTPYMPNVISVPGLGAQPAQSLEKHPELVATMQSLHGAIVVSFGSSVPEFPKTFLKKLVDAFARVSQQVVFRYPFSIPSTVIVPDNVYIYTSWMPQNDLLGNSNTTLFITHCGNNGQYESLYHGVPMIGIPMFAEQYQNCHRAEAHGYGLDMKGVRFSTDDLVAAINEVNQNPLYRNNTKRASLIMKKAALPPMERVAIAIETVMELGGNHLRSAAYDLHWTQYALLDVALVLCIVILILAYVACSLANWMWSEGAKRLSAHAKSD

SEQ ID NO: 8285 - protein, 521 aa, Pieris rapae
MGIMGAFKFWSLLSLLVYFCDAANILFVIPFTTRSHYINLKPIGLELARRGHNVTVITPYRENKHPPNYHQVMVKDTKIWDALGKERPNVFTMVDLTAEEFHNEILWPGGLALTEEALQSSEVQALLRSNTTFDLVVNEQFFQEAFYALATVYNAPLALVTTHGNCMKHNFLTRNSLQWATVTHELLDLHHQTSFLGRLRNMYFSVYELFWWKFWYLEKQEELMRKYIPGLPQKMPSLYDVQKNASLMLLNNHFSVDTPTAYLPNVVEIGGIHVTNSTGALPEDLQKCLDGAVNGVVYVNFGSNVQSSELSQEKKQAFINVFRRLKQTIIWKWEDDKLEDKPKNVIIRKWLPQVEILAHPHVKVFVSHGGLIGTQEALYHGVPLISVPIYGDQLNNVLTLEQLGVGKLLNYHEINEEKLYQLLDEILNNNSYMAKAKEVSKRFVDRPLNALDTAVFWLEYVIRNNGANYMKNPAKDLSWFAYTMIDVYLFIAFIILILMNVSIMLCKFLFFNRILNKMKID

SEQ ID NO: 8286 - protein, 529 aa, Microtus ochrogaster
MPVKWMSALLLLQITCYFRSGSCGKVLVWPLEYSHWMNLKIILDELVQRGHEVTVLRPSSSVFLDPKKASGLKYETFPTTTNNDKVEKFFTEWVNRWIYDVPKDSCWRYYPSFNILFGQFSDFILNLCRKVVSNKQVMAKLKESKFDVVFSDAIGPCGELIAEVLHISFMYSLRHAAGYGLEKFSAGLSFPPSYVPIITSKLSGQMSFMERVENMICLFYFDFLFESFPAKDWDPFFSEILGRPTTMVDTMKKAEMWLIRSYWDLEFPRPTLPNIEFVGGLHCKPAKPLPEEMEEFAQSSGEHGVVVFSLGSMIRNTTKERANAIASALAQIPQKVFWRYEGIEPDTLGPNTRIFKWIPQNDLLGHPKTRVFVTHGGANGIYESIHHGVPMVGIPMFAEQYDNIAHMVAKGAAASVDFHTMTSSDLLNALKEVINNPSYKKNVMYLSTIHHDQPMKPLDRAVFWVEYVMRHKGAKHLKPLAFNLTWYQYYSLDVIGFLLACVAATIFLTIKCCLFVYRFFVKKQKNKKE

SEQ ID NO: 8287 - protein, 517 aa, Polistes dominula
MRLVVLFSLAFIICQSSMIDGYRILGLFPINGKSHWVMIEALMRGLAERGHQVDVFTFFKTKNQHTNYNEILITDNIGSPVNNVTATDILRFTGVNIAHLAQVAGYSLCELIDNPKIKNIIANPPKDPPYDLVIVELFAAHCYLAFGRHLKVPTVGLMTSPFHDWNSHLLGTPNEAAYVPNIFSSFSQNMTFVERLTNTLMIHYLQMQMDYHTNKQSELVKKYFNMDTTITDLFKELSLVLVNSHHSLHGIRSFPQSVIEVGGLHLSNNNTDPLQPEVQKWLDDSKDGCIYFTFGSMVRIETFSKELMEIFYKSFEKIAPTRVLMKVAKKEDLLPGLPKNVMTQSWFSQIPVLKHKNIRGFITHGGLMGTTESIFCGVPMIGIPLFGDQKVNIQNYVKRNVAISLGSIQEVTEEKLTNALKAILNDPSYMTNVKKLSETFNDRSEPALSKAMYWVEYVVKHKNILQSPAIFMPWWQRNLFDVYGSVALVLILVILIIYYIIKFVWKFVTRKNQQKVE

SEQ ID NO: 8288 - protein, 528 aa, Macaca nemestrina
MSMKWTSALLLIQLSCYLSSGNCGKVLVWPTEFSHWMNIKTILDELVQRGHEVTVLAYSPSILPGPNNPSALKFEICPTSLTETEFEDSVTQLVKRWSDIPKDTFWPHFLQVQEMMWTYGDMIRKFCKDVVSNKKLMKKLQESRFDVVLADAVSPCGELLAELLKIPFVYSLRSSPGYAIEKHGGGFLFPPSYVPVVMSEFSDQMTFMERVKNMIYMVYFDFWFQAWDTKKWDQFYSEVLGRPTTLFETMAKAEIWLIRNYWDFQFPHPLLPHVELVGGLHCKPAKPLPKEMEEFVQSSGDNGVVVFSLGSMVSNMSEERANVIASALAKIPQKVLWRFDGNKPDTLGLNTQLYKWLPQNDLLGHPKTRAFITHGGANGIYEAIYHGIPMVGVPLFADQLDNIAHMKAKGAAVSLDFNTMSSTDLLHALKTVINDPFYKENAMKLSSIHHDQPVKPLDRAVFWIEFVMRHKGAKHLRVAAYDLTWFQYHSLDVIGFLLACVATVIFIITKCLFCVLKFVRTGKKGKRD

SEQ ID NO: 8289 - protein, 239 aa, Ictidomys tridecemlineatus
EMEDFVQSSGENGVVVFSLGSMVNNMTEERANVIASALAQIPQKVIWRYDGKKPPTLGPNTRLYKWIPQNDLLGHPKTKAFITHGGTNGIYEAIYHGIPLVGIPLFGDQPDNVMHMKAKGAALRLNFITMSSMDLLNALNTVINEPSYKENAMRLSRIHHEQPVKPLDRAVFWIEFVMHHKGAKHLRVAAHDLSWFQYYSLDVLGFLLACVATVIFIITKCCLFCCQKFTKPRNKKKRA

SEQ ID NO: 8290 - protein, 530 aa, Oryctolagus cuniculus
MSLKWNSLILLMQLSCCFSSGSCGKVLVWPTEYSHWINIKTILDELIQRGHEVTVLTSSASILVDPNKTSTIKFEVYPTSLMKDDLESLFTSWLRKWTYDFKKQTFWEYFSQVQEIFWEYSDCIKMFCKEVVLNKKLMAKLQDSRFDIILADAIGPCGELLAELLEAPFVYSLRFTPGYTYEKYSGGLMFPSSYVPIVLSELTDQMTFMERVKNMIYVFYFDFWFQTFNEKKWDQFYSEVLGRPTTLSETMRKADMWLIRTYWDLEFPRPFLPNFHFVGGLHCRPAKPLPKEMQDFVQSSGEEGVVVFSLGSMVSNMTEERANVIASALAQLPQKIFWRFDGQKPSSLGSNTRLYKWIPQNDLLGHPKTKAFITHGGTNGIYEAIYHGVPMVGIPLFADQPDNIVHMKAKGAAVRLDFNTMTSTDLLNALKTVIYNPSYKENAMRLSRIHHDQPTKPLDRAVFWIEYVMRHKGAKHLRVAAHDLTWYQYHSLDVIGFLLACVGTVVFIILECCLFSYKMFVKTGKKNKKE

SEQ ID NO: 8291 - protein, 528 aa, Unknown
  Description of Unknown: AHD74828.1 Sequence 14845 from patent US 8586006 sequence
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYRPRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYKAISPRIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 8292 - protein, 530 aa, Mus musculus
MPGKWISALLLLQISCCFRSVKCGKVLVWPMEFSHWMNIKIILDELVQRGHEVTVLRPSAYYVLDPKKSPGLKFETFPTSVTKDDLENFFIQLLNVWTYELSRDTCLSYSPLMQNMFDELSGYYLSLCKDVVSNRQLMTKLQESKFDVLLSDPVAFGGELIAELLHIPFLYSLRFTAGYRIEKSSGRFLLPPSYVPVILSGLGGQMTFIERVKNMICMLYFDFWFQMPNDKKWDSFYTEYLGRPTTLAETMGQAEMWLIRSNWDLEFPHPTLPNVDYVGGLHCKPAKPLPKDMEEYVQSSGDHGVVVFSLGSMVSNITEEKVNAIAWALAQIPQKVLWKFDGKTPATLGHNTRVYKWLPQNDLLGHPKTKAFITHGGANSVYEAIYHGIPMIGIPLFGEQHDNIAHMVAKGAAVTLNIRTMSRSDVLNALEEVIENPFYKKNAMWLSTIHHDQPMKPLDRAVFWVEFVMRHKNAKHLRPLGHNLTWYQYHSLDVIGFLLACVAATVVLTVKCLLFIYRFFVTKKKKMKNE

SEQ ID NO: 8293 - protein, 571 aa, Pseudopodoces humilis
MKPYAPAFVLLWSAVGIARAAKIVVVPPIMFESHLYIFKTLASALHDQGHQTVFLLSEGREIPPSNHYRLQRYPGIFNSSTSDDFLQSKMRSIFSGRLTALELFDILDHYSKNCDMIVGNRDLMRALKQEKFDLLLVDPNEMCGFVIAHLLGVKYAVFSTGLWYPAEVGAPAPLSYVPEFNSLLTDHMNLFERIKNTVVYLISRFGVSFLVLPKYERIMQKHKVLPERSMYDLVHGSSLWMLCTDVALEFPRPTLPNVVYVGGILTKPASPLPEDLQAWVNGAHENGFVLVSFGAGVKYLSEDIANKLAHALARLPQRVIWRFSGNRPRNLGNNTKLIEWLPQNDLLGHSNIKAFLSHGGLNSIFETMYHGVPVVGIPLFGDHYDTMTRVQAKGMGILLNWKTMTESELYEALVKVINDPSYRQRAQRLSEIHKDQPGHPVNRTVYWINYILRHNGAQHLRAAVYSISLFQYFLLDIALVLLVGAALLYYVLARMTKLICKQSKHLWCNDKHSAVNGHYQNGIPNGKYRRNGHIKHEKKLEVPWLKEKGGKPVFCLVSLTNMGGVGMMTGC

SEQ ID NO: 8294 - protein, 530 aa, Dipodomys ordii
MTWKWISVLLLLQLSSYFHSGSCGNVLVWPMEYSHWMNMKVILDELIMKGHQVTVVRPSSAIFVDSNEASSIKFETFPSSSNTDEFSAVFSQMISLWTYELPRTTCLAYSPLLENLFMTFSDAMLNICKEAALNTELIARLRKARFDVVIADAVGPCGELLAELLEIPFVYTLRFYPGYTTEKYSGGLLLPPSYVPVILSGLSGQMTFMERVENMICMLYFDFWFETFDSKKWSSFYSEVLGRPTTLMETMSKAEIWLIRSYWDLEFPRPTLPNVDFVGGLHCKPAKPLPKEMEDFVQSSGDNGVVVFSLGSMFQNITEETANEIASALAQIPQKILWRFNGKKPDTLGPNTRLYKWLPQNDLLGHPKTKAFITHGGANGIYEAIHHGIPMVGIPLFGEQHDNIAHMVAKGAAVQLDIRAISSKDLLRALEAVINNPVYKKNAMWLSTIHQDQPMNPLDRAVFWIEFVMRHKGAKHLRPLSHNLTWYQYHSLDVIGFLLACVATVTFLVLKCCLFVYQKVLKKGKKEKSE

SEQ ID NO: 8295 - protein, 466 aa, Jaculus jaculus
MSVKWTSVILWIQLMSLFRLGTCGKVLVWPMEYSHWINMKTILDELVLRGHEVTVLVSSASILIDPSQSSAIKFESFSTSMTKESLEKFFSYWISQWTHNVQDISLWTFHSDIQEAFMQSSDMIQDFCRDAVLNKSLMEKLMTFMERVKNMIYVLYFDFCFQTVNEKKWNQFYSEVLGRPTTLFETMSKADIWLIRMYWDLEFPRPLLPNVHFVGGLHCKPAKPLPKEMEDFVQSSGEDGIVVFSLGSMVSTLTEEKANLIASALAQIPQKVIWRFDGKKPDTLGSNTRLYKWIPQNDLLGHPQTKAFLAHGGTNGLYEAIYHGIPVVGIPLFADQPDNIAHMISKGAAVRVDFNTISSADLLSALRTVLNDPSYKENAMRLSRIHHDQPVKPLDCAVFWIEFVMRHKGAKHLRPALHDLSWFQYHSLDVLGFLLACVLSVVFVITKCCLLCCGKFVKAGKKEKRA

SEQ ID NO: 8296 - protein, 238 aa, Camelus ferus
MEEFVQSSGEDGIVVFTLGSIVTNITEERANVIASALAQIPQKVLWRFNGKKPDTLGPNTRLYKWIPQNDLLGHPKTKAFITHGGANGIYEAIYHGIPMVGIPLFADQPDNIAHMTAKGAAVRLDFNKISRIDLLNALKQVINNPSYKQNAMRLSTIQHDQPVKPLDRAVFWIEFVMRHKGAKHLRPAAHNLTWYQYHSLDVTGFLLACVATAIFVITKCCLFCCQKFPKAGKKNKRE

SEQ ID NO: 8297 - protein, 531 aa, Microcebus murinus
MAMKLASVLLLMQLSGHFSSGTCGKVLVWPTEYSHWMNMKTILDELVQRGHEVTVLTHSVSILVDPKQATSIKFEVFPTSLTKSDFEDVIIQLINKWIYDLPKDTFWSYFSQVQEITWKFSEIMMKICKDAVLNKKLMTRLQESKFDVVLADAITPCGELLAEILKTPLVYSLRYSPGYQFEKSSGGLLFPPSYVPVVLSELNDQMTFMERVKNMIYVLYFDFWFQTFNMKEWDHFYSEVLGRPTTLYETMKRADMWLIRTYWDLEFPRPLLPNIEFVGGLHCKPAKTLPKEMEDFVQSSGENGVVVFSLGSMLSNMTEERANVIASALAQIPQKVLWRFDGKKPDTLGPNTRLFKWMPQNDLLGHPKTKAFVTHGGANGVYEAIYHGVPMVGIPLFADQPDNIAHMKAKGAAVRVDFNTMSSTDLLSALKTVLITYVEYKENAMKLSRIQHDQPMKPLDRAVFWIEFVMRHKGAKHLRVAAHNLTWFHYHSLDVLGFLLACVATAIFVITKCCLFFNRMFATAGKKEKRE

SEQ ID NO: 8298 - protein, 445 aa, Galeopterus variegatus
MSMKWNSVLLLLQLSCYFSSGSCGKVLVWPTEYSHWMNMKTILDELGQRGHEVTVLTSSASIHVDPNKTSTIKFEVYPTSLSRDAFDAFVLMVVKKWERIPKDRIWLHLSEMQEIMWDFSDCMRNMCKDAVLNTKLMRKLKESKFDVVFADAIGPCGRPTVLLETMAKAEIWLIRSYWDFDFPRPLLPNFDFVGGFHCKPAKPLPKEMEDFAQSSGEHGVVVFTLGSMISNMPEERANVFASALAQIPQKVIWRFDGKKPDTLGANTRLYKWIPQNDLLGHPKTKAFITHGGGNGVYEAIYHGVPMVGMPLFADQPDNIARMMAKGAAVRLDFDTVSSTDMLNALKTVINDPLYKENIMRLSRINHDQPTKPLDRIVFWIEFVMRHRGAKHLRVAAHDLNWVQYHSLDVIGFLLACVATVIFAITKCCLLCCQKFAKTGKKEKRE

SEQ ID NO: 8299 - protein, 445 aa, Ochotona princeps
MSLKQVSVLLLLLQLSCCFRSGNCGKVLVWPMEYSLWLNLNVILDELVRRGHEVIVLRNSASIFLDPSKHTGIKFETFPIDATKADSEAFFVQLVTTWTNALQDPYWEYLPALQKLFSGYSDDREFLCKAAVLNKKLMRKLQESKFDIIISDTFGPCGRPVTFYELVAKADMWLIRSYWDLEFPRPTLPNVHFVGGLHCKPAKPLPKDMEDFVQSSGEEGVVVFSLGSMVSNMTEERANVIASALAQLPQKVLWRFDGKKPETLGPNTQIYKWIPQNDLLGHPKTRAFVTHGGANGIYEAIYHGVPMVGLPLFADQPDNIAHMTAKGAAVRLNWKTMSSADLLNALRTVIHDPSYKENVMMLSRIHHDQPMKPLDRAAFWIEHVMRHKGAKHLRVAAHDLTWYQYHSLDVIGFLLACVTITTYLVIKICLSVYQKLVKTEKKKSD

SEQ ID NO: 8300 - protein, 520 aa, Aplysia californica
MGFYSTLFASFLAVTIQQTVFLGTVAEAKVVLFFSVPHTGVVRTHINVARSLADLGHEVWVAVPHYMLDRKVVDVTGVKVVEYGRYLDNFERKGFETLLSSDSNTFFKRVFGYKKIAEKMRGAFRQILNDTALMERIRSLEPDLMILFNMPGAREFVVLPYVLGIKFVFLGPYHDLHGYRVPFVPSASPFFLTPFDVNEELDLGQRIKNTLQNVALYLINEFVLSADLLSEFAPAKPWMSVPDMMLKAELFLVESDHILDVTKPLLPNTKLIGGTASSQAQPLRDPFKIFVENSENGVVVVSFGSSIVNLPQEVADKLASAFQRLNQTVVWRVNMTSSDPGKVMTSMWLPQNDLLAQAQTRLFVSHCGSSGQYEALYHGVPLLCLPLCCDQYYNAYRSSSKGFGLTADVFSTTDDQLYTIMAEILNNATYRDNIRRASKLFRELYKEPQAEAAFWIDHVMKYGGGYMRWAGQDIPQWQFLGLDVLACAVGCVVVIVSVVRVVSRMCLGISCRRERKLKSE

SEQ ID NO: 8301 - protein, 382 aa, Mus musculus
ILSDAIGPCGELIAELLQIPFLYSLRFSPGYYLEKYSGGLPLPPSYVPVILSGLSGQMTFKERVKNMICMLYFDFWFQTFREKKWDQFYSETLGRPTTLIETMGKAEMWLIRSYWDLEFPHPTLPNVYYVGGVHCKPAKPLPKEMEDFVQSSGEHGVVVFSLGSMVSNMTEEKANAIAWALAQIPQKVLWRFDGKTPATLGPNTRIYKWLPQNDLLGHPKTKAFITHGGANGLYEAIHHGIPMIGIPLFGEQHDNIAHMVAKGAAVTLNIRTMSRSDLLNALEEVIDNPFYKENTMWLSTIHHDQPMKPLDRAVFWIEFVMRHKGAKHLRPLAYNLTWYQYHSLDVIGFLLAFVTFIVALIVKCFLFVYRFFVKKEKKMKNE

SEQ ID NO: 8302 - protein, 446 aa, Fukomys damarensis
MSMKWISALLLLQLDCYFSFGSCGKVLVWPMEYSHWMNMKNIVEELIQRAHEVTVLRPSSFIFVDVNSSSGIKFETFITSTNDDQLEDIYIESVNKWMSVGSIDTCLAYFPVLEDTIRDYSAIWENICKDVASNKKLMTKLQESRFDVLLADPIAPCGRPTTLHEIMGKAEMWLIRSYWDLEFPRPSLPNFDFVGGLHCKPAKPLPKEVEDFVQSSGEHGVVVFSLGSMISSMTEERANAIASALAQIPQKVLWRFEGKKPDTLGSNTRLYKWLPQNDLLGHPKTRAFVTHGGANGVYEAIYHGIPMVGIPLFAEQHDNVAHMKAKGVAVKVEFMTISSTELLNALKKVLNSPSYKENAMWLSTIHHDQPMKPLDRAAFWIEFVMRHKGAKHLRPLAHNLTWYQYHSLDVIGFLLAGVVTITLLVVKCCFFISRKFLKMKKKKKRE

SEQ ID NO: 8303 - protein, 232 aa, Canis lupus familiaris
MELTFSSQEMEEFVQSSGENGIVVFSLGSMINNMPEERANVIASALAQIPQKVLWRFDGKKPDNLGRNTRLYKWIPQNDLLGHPKTKAFITHGGTNGIYEAIYHGIPMVGIPLFADQADNIVHMKAKGAAIRLDLSTMSSADLLDALRTVINDPSYKENAMKLSGIHHDQPIKPLDRAVFWIEYVMRHQGAKHLRPASHDLTWFQYHSLDVIGFLLACVATAIVVTTQGWPA

SEQ ID NO: 8304 - protein, 413 aa, Carlito syrichta
MSIKWTSVLLLIQMSCYFKSGGCGKVLVWPTEYSHWLNMKAILNELVQRGHEVTVLTSSASILVDPSISSSIKFEVYPTSLTKDDFENVLGELVDTWMYDLPKYNFCFQILDMKKWDQFYSEILGRPTTLSETMGKAEMWLIRTYWDFEFPRPFLPNVDFVGGLHCKPAKALPKEMEDFVQSSGENGVVVFSLGSMVSGLTEERANVIASALAQLPQKVLWRFNGKKPHTLGPNTRLYNWIPQNDLLGHPKTRVFITHGGTNGIYEAIYHGIPMVGIPLFADQPDNIAHMVTKGVALRVDFNTMSSTDLLNALKIVINDPIYKENAVKLSRIHHDQPAKPLDRAVFWIEFVMRHKGAKHLRAAVHDLTWFQYHSLDVIGFLLACVAAVIFTITKCCLFCFRKFAKTRKKGKRD

SEQ ID NO: 8305 - protein, 445 aa, Dipodomys ordii
MSLKWMSLLLLIQVMYCFNAGSCGKVVVLPMEYSHWLNVKIILDELVQRGHEVTVLTSSAAVHVDSGKSSPFKFETFPTPLTTKEFERHFKHSVNIWTYEFPKYSIWKLYSKMQSMFEEHSDVLESLCKYMIFNEKLRKTLQESKFDVLLADPVVPCGRPTTILELMAKADIWLIRTYWDFDFPRPLLPNFEFVGGLHCKPAKPLPEEMEKFVQSSGDQGVVVFSLGSIVSNLTEERANTIASGLAQIPQKVLWRYEGPKPETLGSNTRLYKWIPQNDLLGHPKTKAFITHGGTNGVYEAIYHGVPMVGIPLFVDQPDNIARMKAKGAAVRLDFTRFSSEELINALKTVINNPFYKENAMKLSRIHHDQPVKPLDRAVFWVEFVMRHKGAKHLRPAVHDLNWFQYHSLDVIGFLLACVATAIFIFTRCCLFCCRKFPKSRKKKRE

SEQ ID NO: 8306 - protein, 782 aa, Tribolium castaneum
MWSKVILFVFFVNYGNSANILGLYFHAGKSHHILGEMLLKELARRGHNVTMASPFPLKEPFPNYTDIHLTGILEDQIARESMFMKMNKGHALVGVNDVLELTRAQTELTLNHTEMAKLLKSGTKFDVIIIDWFMNGAILMYGKLFNAPIIPIASHGTTHLANYIVGNPAPPSYIPNAMLPFPPNMTFFQRMVNGLVTIAYNVVGHTNAKYHQALLEKYFENAPSLDELKDTVALVLSNGHYSFESPRPFVPNVIPVGGFHVQKARKLPTDLQKYMDEAKHGVVYFSLGSNMKSVLLPKEKQQQILKAFAKIPHKVLWKWEDDNLENKPDNVLIRKWFPQNDILGHPNLKLFITHGGLLSTIEALHHGVPVLGIPIFGDQKANIPNAVSSGYAVQLELADLDEATLTKALDEILTNPKYQENAKKRSQLLHDQPMSPMDTAVFWVEHVIRHKGAPHLRNLGSYLPWYQYLMLDVALFVVLFLLVVVGIVGFVIRKICGCCCQRKSKEKRDALRGAAAAASRRMSGCDPVCTKRQCSSVLNMFTLCMSRGHPPLQNAQQENNVANKQVKGGYLLRYKRGLFCNSWCEEWFVLYEDSTLAWFKDKGLNRPKGHLRISECPDLLAVGEWTRQVPKRPRFPRNYHVGQVLAVGTRIPQDVHWLMAQSAAEANDWMTAISNTLPPPPNLPPAKSKSFTFQKKSNNCYKCNSLKNEADYTLISGVAIDWGHGWGWGQTAWAAHTACVSETATALEAAVNSALHCHALGDYGVGSGMDELDCSAFGDFIF

SEQ ID NO: 8307 - protein, 486 aa, Fukomys damarensis
MSMKLTAILLLLQLSSYLGSGSCGKVLVWPMEYSHWINLKTILDVLVQKGHEVTVLRSSVSISLDVEKESAIKFETYPTSLCRDDWEYIFTDELRKLIYELPKESKWTYFSILQEIMWVDSSYMEITCKELVLNKELMSKLQEPSFDVLLADAFTPCGELIAELLHIPFVYTHRSFPGYTYEKYSGKLPFPPSYVPVALSELTDQMTFMERVKNMIYVLYFDFWFQAFNEKKWNQFYSEVLGRPTTLSEIMGKAEMWLIRTYWDLEFPRPSLPNFDFVGGLHCKPAKPLPKVIWRFDGKKPDTLGPNTQLYKWIPQNDLLGHPKTKVFVTHGGTNGIYEAIYHGVPMVGIPLFYDQADNIVHMKAKGAAIRLDFITMTRTDLLNALETVIDDPSYKENAMRLSRIHHDQPVKPLDRAVFWIEFVMRHGGAKHLRVAAHDLSWFQYHSLDVIGFLLACVATVIFIITKCCLFCYQKLAKTGKKKKRE

SEQ ID NO: 8308 - protein, 334 aa, Microtus ochrogaster
MSVKMTAALLLLQLSGFFGSGSAGKVLVWPMEYSHWLNLRTILDELVKKGHEVTVLIPSASLSYEVGDTSAIKFETYPSSTSLADVAAIFMESIRKCVYELPKQSFWGYFVLLQEVVWENSNYFESLCKDVVFNKELRKPTTLAETMGKADIWLIRTYWDLEFPHPVLPNFDFVGGLHCRPAKPLPKEIEDFVQSSGEHGVVVFSLGSTVGTLTEERANVIAAGLAQIPQKVLWRFEGKKPDTLGSNTRLYKWIPQNDLLGHPKTRAFITHGGTNGIYEAIYHGIPVVGIPLFGDQFDNVVHMKTKGAGVRMDFLTMSSTDLLHAVKTVTNDPS

SEQ ID NO: 8309 - protein, 446 aa, Loxodonta africana
MSMKWISVLLLIQLSCCFSCGTCGKVLVWPPEYSHWMNMKTIVDELIQRGHEVTVLTPSASVLIDPNKPSAIKFEVYPTSLTEDEFEYVFMKLVRRWTNEVPKDTFWTCFSVLQEILSEFSDFMERLCKDVVFNKKFMMKLQESRFDVILTDAVFPCGRPTTFSETRGKAEIWLVRNYWDFQFPRPFLPHFHFVGGLHCKPANPLPKEIEEFVQSSGKHGVVVFTLGSMVSNLTEERANMIASALAQIPQKVLWRFDGKRPDTLGPNTWLYKWIPQNDLLGHPKTKAFITHGGANGIYEAIYHGIPMVGIPLFADQPDNIAHMKVMGAAVRLNMDTMTSTDLFNALKTVIYDPSYKENAMRLSAIHRDQPVKPLDRAAFWIEFVMRHKGAKHLRPAALSLTWYQYHSLDVIGFLLACVAIVSFLVIKCCLLGYQKFYKTRKKKKRE

SEQ ID NO: 8310 - protein, 529 aa, Dipodomys ordii
MTWKWNSVLLILQLSYYFNSGSCGKVLVWPMEYSHWMNIKVILDELILRGHEVTVLRPSSAIFIKSNEVSSIKFETYPSSYTTEERITISTEMIRRWTYEMPRTCLAYSPLLENIMWKFSNIWLNICREAALNKEFIAQLQKGRFDIVIVDPIGACGELLADLLKVPFVYSIRSSPGYKIEKYSDGFLFPPSYVPVILSGLSGQMTFMERIENMLCMLYFDFWFEIFDLKKWNNLYSEVLGQPTTLMETMSKAEIWLIRSYWDLEFPRPTLPNVDFVGGLHCKPAKPLPKEMEDFVQSSGDNGVVVFSLGSMVGNITEETANEIASALAQVPQKVLWRFNGKKPDTLGPNTRLYKWLPQNDLLGHPKTKAFITHGGANSIYEAIHHGIPMVGIPLFGEQHDNIAHMVAKGAAVQLDIRAISSKDLLRALEAVINNPVYKKNAMWLSTIHQDQPMNPLDRAVFWIEFVMRHKGAKHLRPLSHNLTWYQYHSLDVIGFLLACVATVTFLVLKCCLFVYQKVLKKGKKEKSE

SEQ ID NO: 8311 - protein, 483 aa, Culex quinquefasciatus
MNQLAQHGHNITALSVNTDPNAVENITYIHLENTYNVLYGDGKANNNILKRSEENPFQATMSFYKFGTLGCIGATSSAGLQRLMEYPDDFPFDLVIYDFTCGPCVLGFLQKFNYPPLVSLTGFSIPQFSHHLVGGHKPSSYVPHFSLRYDTKMDFFQRMINFIVQNFDSIYREWVFLPHMQRLAQTAFNFTLPNLAELEQRTQIMLVNTNPVLDPPETLPQHVIPVGGLQIVQPKPLVEEISNFIESSSKGTVLFAMGTNFKSKMFTRDRQAMFIEAFALLPEYNFLWKFDDDNLPIPAPKNLMVRAWLPQNDILAHPRLKAFITHCGLLSTYEASYHGVPTIGIPIYVDQHRNAQRSARAEVGVTLDLKNLSTEAIRRALLRVLTGEKFATNMAKRAQLLRDQTESPLDRAVWWIEWVLRHPHSNHMRSPMLDLGYFAKGNIDVFVFLCLFLAIVLTVILKCIKNLIKKSHQTDCDKKEKLK

SEQ ID NO: 8312 - protein, 300 aa, Sus scrofa
MVGPASSTDKNGKPTTLCEVMGKAEMWLIRTYWDFEFPHPYLPNFEFVGGLQCKPAKQLPQELEEFVQSSGRDGVVVFTLGSMVKNLTEEKSNMVASALAQIPQKVLWRYKGKKPETLGANTRLYEWIPQNDLLGHPQTRAFITHCGTNGIYEAIYHGVPVVGIPLFGDQFDNIARVQAKGAAVQLDLNTMTSSDLLKALRTVINNSSYKENAMKLSRIHHDQPVKPLDRAVFWIEFVMNHKGARHLRPAVHDLTWYQYHSLDVIGFLLACVAVVVFLVTKCCLFCCWKFGKISTKRKRE

SEQ ID NO: 8313 - protein, 444 aa, Bos mutus
MAMKRLLLLLLLQLTCYFSSGSCGKVLVWPVEYSHWMNMKIILDELVMRGHEVTVLTSSASILIDPNKPSAIKFENFSVSLTKDDFEDALKNFVGNWTDLTNSFWTFPLLLQSLFDEYSDLTLKICKELISNKKFMTKLHESRFDVVLADTVGPCGEPTTLLETMGKAEFWLFRSYWDFEYPCPLLPNVEFIGGLHCKPAKPLPKEMEEFVQSSGENGIVVFTLGSMVTNVTEERANMIASALAQIPQKVLWRYDGKKPDTLGPNTRLYKWVPQNDLLGHPKTKAFITHGGTNGIYEAIYHGVPMVGLPLFAEQPDNINRVKAKGAAVRLNLETMSKTDFLNALKQVINNPSYKRNAMWLSTIQRDQPMKPLDRAVFWIEFVMRHKGAKYLRPAAHKLTWFQYHSLDVIGFLLACVATAVFVITKCFLFCCRKFAETGKKRKRE

SEQ ID NO: 8314 - protein, 275 aa, Heterocephalus glaber
MWLIRSYWDLEFPHPSLPNFDFVGGLHCKPAKPLPKEMEDFVQSSGEHGVVVFSLGSMVSNMTTERANMIASALAQIPQKVLWRFDGKKPDTLGPNTRLYKWLPQNDLLGHPNTRAFVTHGGANGIYEAIYHGIPMVGIPLFAEQHDNIAHMKAKGAAVKVEFITLSSTELLNALDTVLNNTSYKENAMWLSTIHHDQPVKPLDRAVFWIEFVMRHKGAKHLRPLAQNLTWYQYHSLDVIGFLLACVATVTFLVIKSCLFCSQKFVKKGKKQKRE

SEQ ID NO: 8315 - protein, 529 aa, Mus musculus
MPVKWISALLLLQMSCCFRSTSCGKVLVWPLEFSHWMNLKIILDELVQRGHEVTVLRPSASIFVDPKYSPGLKFETFPTAFSKDYLETFLTKLVDEWTFEVPRDTCLSYSLLQTLFGKLSDYSLSLCKEAVSNKQLMTKFQESKFDVLILDAMASCGELIAQLLQIPFLYSLRFSPGYQVEKNSGGFVLPPSYVPVILSGLGGQMTFTERVKNMICMLYFDFWFQTFTEKEWDQFYSETLGRPTTLIETMGKAEMWFIRSYWDLEFPHPTLPNVEYVGGLHCKPAKPLPKEMEDFVQSSGVHGVVVFSLGSMVSNMTEERANAISWALAQIPQKVLWRFDGKTPASLGPNTRIYKWLPQNDLLGHPKTKAFVTHGGANGLYEAIHHGIPMIGIPLFSEQHDNIAHMVAKGTAVALNIRTMSRSDLLNALEEVINNPSYKENVMWLSTIHHDQPMKPLNRTIFWIEFVMRHKGAKHLRPLAHNLTWYQYHSLDVIGFLLVCVVATAVLPVKCCLFVYQFFVKKAKKRKNE

SEQ ID NO: 8316 - protein, 279 aa, Poecilia mexicana
LIVAILSLFLQYFQALVNDTAEHGFVVVSFGAGVKYLSQDIAHKLAGALARLPQRVIWRFSGVAPSNLGNNTKLVDWMPQNDLLGHPHTKAFLSHGGLNSIYEAMYHGVPVVGVPLFGDHYDTMTRVAAKGMGVMLHWKDMTEEDLYASLSSVINDPRYRQQARLLSNIHKDQPGHPVTRAVYWIGYILRHSGANHLRSAVYEVSPYQYFLVDVLLAVAAAGALIVFLLRRLVRLLRGKAGDHSRRVDGSMTNGHCHSESIANGKHKRNGSLKTEKKIN

SEQ ID NO: 8317 - protein, 530 aa, Unknown
  Description of Unknown: AHD78779.1 Sequence 27388 from patent US 8586006 sequence
MSLKWTSVFLLIQLSCYFSSGSCGKVLVWPTEYSHWINMKTILEELVQRGHEVTVLTSSASTLVNASKSSAIKLEVYPTSLTKNDLEDSLLKILDRWIYGVSKNTFWSYFSQLQELCWEYYDYSNKLCKDAVLNKKLMMKLQESKFDVILADALNPCGELLAELFNIPFLYSLRFSVGYTFEKNGGGFLFPPSYVPVVMSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENVMKLSRIHHDQPMKPLDRAVFWIEFVMRHKGAKHLRVAAHNLTWIQYHSLDVIAFLLACVATVIFIITKFCLFCFRKLAKTGKKKKRD

SEQ ID NO: 8318 - protein, 533 aa, Buceros rhinoceros
MAAKAASSKKYLQLLLFPVTLLGPVFCGNVLVWPAEGSHWLNVQGVIRELIHRGHSVTILVHSSSLYIKPRADAAEKFEVYDVPFQTDTLRNMIDDAVALWVNNRPTILTFWQFYKELGKQSENWNQIARMICDAALTNQELMARLQRSNYDVVLSDPAALCGDLLALKLAIPFIYSLRFSPASTMERNCGKIPAPPSYVPAALSELSDRMSFSERVKNIVSYHVQEHIFQTFWGEWDVYYSKILGRPTTLCETMGKAEVWLIRTYWDFEFPRPFLPNFEFVGGLHCQPAKPLPKEMEEFVQSSGEHGIVVFSLGSMVHNLTDEKTNVIARALSQLPQKVLWRYKGKKPETLGSNTRIYDWIPQNDLLGHPLTKAFITHGGTNGIYEAIYHGIPMVGIPIFADQHDNIARMRAKGAAIGLDFITLKSQDLVDALNTVINNPSYKENALKLSKIQHDQPVKPLDRAVFWIEFVMRHKGAKHLRPAAHNLTWYQYHCLDVLAFLLTCTTIVVFILVKCCLFCCRRCGRIAKKKKE

SEQ ID NO: 8319 - protein, 412 aa, Carlito syrichta
MSMKWVSVPLLIQLSCYFSSGSCGKVLVWPTEYSHWLNMKTILDELVQRGHEVTVLASSISILVDPNKSSTIKFEVYPTSLTKNDYKNTITRVINLWTHAPKDSFWFQTFDMMKWDQFYSEVLGRPTTLLETMGKAEMWPIRTYWDFEYPRPLLPNFDFVGGLHCKPAKALSKEMEDFVQSSGENGIVVFSLGSMVSDMTEERVNVIASALAQIPQKVLWRFNGKKPDTLGPNTRLYKWIPQNDLLGHPKTKAFITHGGTNGIYEAIYHGIPMVGLPLFADQPDNMAHMKTKGVAISLDYHTMSSTDLLNAVKTVIHNPLYKENAMKLSEIQHDQPMKPLDRAAFWIEFVMRHKGAKHLRVAAHDLNWFQYYSLDVIGFLLACVATVIFTVTKCCLFFFQKFAKTERKGKKD

SEQ ID NO: 8320 - protein, 445 aa, Ochotona princeps
MSARWISVLLLLQLSCHFSAVGCGKVLVWPMDFSHWINMKTILDELVQRGHEVTVLKSSVSVLLDHNESSAIKYETFPVSTPKDVYEKAFSNDLMKHVYELHKYSFWNFLSKLQQIQYEISDFFQIICRDAVLNKELVTKLKESRFDVIFADTLCPCGRPTKLTELMGKAEMWLIRTYWDLEFPRPLLPNVDFVGGLHCRPAKPLPKELEDFIQSSGEEGIVLFSLGSMVSNLTEETANVIATALAQLPQKVLWRYSGKKPRTLGPNTQLHTWVPQNDLLGHPKTRAFITHGGTNGIYEAIHHGVPLVGIPLFADQFDNIAHVKAKGAAVKVDFITMSSADLLSAVKTVINDPSYKENAMTLSRIHHDHPMKPLDRAAFWIEHVMRHKGAKHLRVSAYDLTWYQYHSLDVIGFLLACVTTAALIIIKCCLFCYRMFVKSVKRKRE

SEQ ID NO: 8321 - protein, 315 aa, Chinchilla lanigera
  MOD_RES (67)..(74): Any amino acid
MLHLLYFDFWFQTFNEKKWSQFYSEILGRPTTLSQSMAKAEMWLIRSYWDLEFPRPTLPNTEFVGGXXXXXXXXLSQEMEEFVQSSGEHGIVVFSLGSMIYNLTEERANVIASALAQLPQKVIWRYSGKTPDTLQANTQLHDWIPQNDLLGHPKTKAFVTHGGANGVYDAINHGVPMVGIPLFGEQHDNIAHMEAKGTAVALDFQTMSTTDLVNALKEVMNNPSFKENVMRLSTIHHDQPVKPLDRAIFWIEFVMHHKGAKHLRPLAQNLTWYQYHSLDVIGFLLACVVTVTLLVTKCCLFCYQKIVRIGKKKKE

SEQ ID NO: 8322 - protein, 531 aa, Oryctolagus cuniculus
MSVKSVSVLLLLLQLSCCFSSGSCGKVLVWPMEFSHWMNMKVILDELVQKGHEITVLRSSASVLIDHKKQSGIKFETFPTTSTQEELDVFFTNWVNILINDVSREKYWEYFPLWQKFFLQYSEIYENFCKDLVLNKKLMTKLQESKFDVVFADAIAPCGELLAEFLKIPLVYSLRFTPGYTYEKYSGGLLFPPSYVPAITSVISGQMTFTERVKNVLWMLYFDFWFQTFNVKRWDQFYSEVLGRPVSFYELVGKADIWLIRSYWDLEFPRPLLPNFEFVGGLQCKPAKPLPKEMEAFVQSSGEEGVVVFSLGSMVSNMTEERTTVIASALAQLPQKVLWRFDGKEPDTLGPNTKLYKWMPQNDLLGHPKTKAFITHGGSNGIYEAIYHGIPMVGLPLFSEQPDNIAYMAAKGAAVRLDWKTMSSTDFLNALKTVINDPSYKESIMKLSRIHHDQPMKPLDRAVFWIEYVMRHKGAKHLRIAAHDLTWYQYHSLDVIGFLLACVTIITYLVIKCCLFVYQKLAMTGKKKKKD

SEQ ID NO: 8323 - protein, 536 aa, Capitella teleta
MVDGVYNEAVEDIRSSRTDNMLRFVLLFCLMLASGNGSKILLLPTPFTGHLNYFVPLGKALVDEGHEVHIILSTGSKGVDLIQKQGIKVMQYLAEDGICHLVTDSFYKNVSLGMLENPDPRLLAGIVAPAVAKECEFFLKDDSVLKQAKKVNFDLAVVDGLFFARCLYLFPVKLEIPYVTLTTFQEFWMMKVPAMPSHVPFHYLGFTQKMTFPQRMINTLVNIVWVLGSGKSPELPDVVKDRYSDVIARVDFDSLILKSKLWFFNSDISLDYPKPSMPNVVNIGGMSPKPAKPLEEELMKWMDGSTNGVVVASFGSVISYIPLELSNKLLKAFAELPYNVLWRNKNITGLTVPDNVRVMSWLPQNDVLGHPNTVAFVTHCGNNGQFEALYHKVPMIGLPVFADQPYNGLRMEQKGFGINMDIRTFKPEELTHNILRVATEPSFRTNIAKGSGIFKSRQSRLAATVAFWLEHVVEHGGDHLRSHAMDMPAYQYLLLDVFAVFFLVTLFVLAMILFLCRGIFRMFAQVRQGSEKEKNE

SEQ ID NO: 8324 - protein, 445 aa, Ochotona princeps
MSLKHVSVLLLLLQLSCCFRSGSCGKVLVWPMEYSHWMNLNAILDELVRRGHELIVLNHNASIFVDSGKTTTIKFETFPIDITKNDLEMFYMQVINTWTNALQDSYWEYLPALQKIFSEYSDICKDICKAAVLNKKLMTKLQRSKFDILLSDPIGPCGRPVTFYELVAKADMWLIRSYWDLEFPRPTLPNVHFVGGLHCKPAKPLPKDMEDFVQSSGEEGVVVFSLGSMVSNMTEERANVIASALAQLPQKILWRFDGKKPETLGPNTQVYKWIPQNDLLGHPKTRAFVTHGGANGIYEAIYHGVPMVGLPLFGDQPDNIAHMTSKGAAVRLNWKTMSSADLLNALRTVIHDPSYKENVMMLSRIHHDQPMKPLDKAVFWIEHVMRHKGAKHLRVAAHDLTWYQYHSLDVIGFLLVCVIIIAYLVIKICLFVYQKLVKTEKKKSD

SEQ ID NO: 8325 - protein, 532 aa, Bubalus bubalis
MNKMSMKWLLLLQLLQLTFYFSSGSCGKVLVWPVEFSHWMNMKTILDELVTRGHEVTVLQSSASTLIDPNKPLAMKFETFPVSLAKDDFQTLAKILIETWMLVVKDFFWIHLSTMQSLLDEFSDIGIKICKEVVSNKKLMTKLQESRFDVVLADAVGPCGELLAEILKVPLVYSLYFSPGYLVEKRSARLSFPPSYVPVMLSELSDHMTFMERVKNMIYVLYFDYWFQLYNEKKWNQFYSEVLGRPTTIAESMGKAEMWLIRNYWDFSFPRPGLPNVEFVGGLHCKPAKPLPKEMEEFVQSSGEHGIVVFSLGSMVSNMSEERANVIASALAQIPQKVLWRYDGKKPDTLGPNTRLYKWIPQNDLLGHPKTKAFITHGGSNGIYEAIYHGIPMVGLPLFADQPHNIVHMTAKGAAIRLDLETMSTADLLNALKEVINNPFYKENIMRLSAIQHDQPMKPLDRAVFWIEFVMRHKGAKHLRPASHNLTWFQYHSLDVIGFLLACVATVVFVITKCCLFCCRKFANIGKKGKRD

SEQ ID NO: 8326 - protein, 529 aa, Bos taurus
MKTVKVFCILFMLHLCLFDSGMTGKVLVWPADFSHWINLQVILEELHHRGHEITVLIPSPSLLIDHTKVPYNVEILQLSVTKETSMEEMNTILYEASFDMSKFSWWKMQIKLANIGRKFLLITKRVCDSAVTNKELLNRLQAAKFDVCIADPLRFCGELVAELLNIPFIFTFRLLYGNVIERLCAGLPMPSSYIPCITSRLTDNMTFIQRLENWLLYTVNDVIYSYYVFPEWDEYYSKVLGKPTTLCEIMGKADMWLFRSYWDFEFPQPYLPNTEFVGGLHCKPAKPLPKEFEEFVQSSGKDGVVVFTLGSMIKNLSEEKSNMIASALAQIPQKVLWQYTGKKPETLGANTRLYKWIPQNDLLGHPKTRAFITHCGTNGVYEAIYHGVPMVGIPLFADQYDNVVRMQAKGAAVEVDLQRMTSADLLNALKEVINNPFYKENAMKLSRIHHDQPVKPLDRAVFWVEFVMHHKGAKHLRPAFHDLNWFQYHSLDVIGFLLACVATVAFLVTKCCLFCYWKFGKTAKKKKIE

SEQ ID NO: 8327 - protein, 952 aa, Blattella germanica
HFSISFPRPLTPNVVQVGGLHVKPPKKLPLVTHPNVKLFITHGGLLSTQETIDRGVPVIGIPIYGDQYMNMANTVSLGIGVKLELSNISMDSVLWAINEILDNPSIFASHLSLLIWICLVSCLHLGEGARILGIFPIPSKSHWAVNQALIQELAKRGHKLTVLTPFPEKSQPNYKEIVIQANREDVLNNTVSLMVWNMGNLVTDQMLQLGAVQDLIHSDQEFDLIISEGFFTDGFLGFVHKFKAPLIQTISFGGFHWMHDWVGNTSPYAYIPNTFLGFSDKMNFWERLQNTFTLTFEKVTRRIMFVPEQQKIMEKHFGKFGPLPSIDDIHASTSLMFLNNHFSTSYPRPLLPNIIEVGGMHIKPPKKLPEDLQKYLDDAPDGVVYFSLGSHFYSSDMPDWKVNSFLKAFSKLKQKVLWKWEKDTLPGQPKNVKLGKWLPQSDILAHPNVKLFMTHGGLLSTQETIYRGVPILGIPLTADQKMNTYVIRHKGAPHMRSAALDLTWYQYFLLDVFAALVLAVGIVLSITFLLVRAVYRKCCRRSKIKNRRGHELTVITPFPEKSPPPNYRDIVVQASRDDFLNETGHTNSLTMVDFNLIQMVLMMWGIGNSVSDQLLQQEAIQELINSDQQFDLILIEGFFNDAFLGFVHKFKVPFIQIITFGGLHWMHDWVGNTSPYAYVPEAFLGFSDKMNFCERLQNTLMITFEKVTRRIMFIPEQQRLIEKYFGQFGPPPSVDDIHASTSLVFLNNHFSTSYPRPLLPNIVEVGGMHIKPPKKLPEDLQKYLDDAPDGVIYFSLGSNFYSSDMPDWKINAFLEVFSKLEQKVLWKWEKDTLPGQPKNVKLGKWLPQSDILGGYRENAKRTSKIYQDQPLTPLETAVFWTEYVIRHKGAPHMHSAALDLSWYQYFLLDVIAVLFLAVGIVASIMFILIRAVYRKCCGKSKIKKRVSSKKTN

SEQ ID NO: 8328 - protein, 283 aa, Dipodomys ordii
METMSKAEIWLIRSYWDLEFPRPTLPNVDFVGGLHCKPAKPLPKEMEDFVQSSGDNGVVVFSLGSMVGNITEETANEIASALAQVPQKVLWRFNGKKPDTLGPNTRLYKWLPQNDLLGHPKTKAFITHGGANSIYEAIHHGIPMVGIPLFGEQHDNIAHMVAKGAAVQLDIRAISSKDLLRALEAVINNPVYKKNAMWLSTIHQDQPMNPLDRAVFWIEFVMRHKGAKHLRPLSHNLTWYQYHSLDVIGFLLACVATVTFLVLKCCLFVYQKVLKKGKKEKSE

SEQ ID NO: 8329 - protein, 485 aa, Bison bison
MKIVKGFCILFMLHLCLLDSGRTGKVLVWPVDFSHWINLQFILEELHLRGHEITVLVPSQNLLIDHTKVPYHVEILQLSVTEETFMEEFNSMLYEEIFELPKLSWWEMQIKLADLVRKFLLTNKRVCDSAITNKELLSRLQAAKFDVCIADPLSFCGELVAELLNIPFIFTFRFFYGNAIERLCAGLPMPSSYVPGVTSRLTDKMTFIQRLQNWLLYTVSDMIYSYYIFPEWDEYYSKVLGKPTTLCEIMGKADMWLFRSYWDFEFPQPYLPNTEFVGGLHCKPAKPLPKVLWRYTGKKPETLGANTRLYKWIPQNDLLGHPQTRAFITHCGTNGIYEAIYHGVPMVGIPMFGDQHDNLARMKAKEAAVEVDLQRMTSADLLNALKAVINNTSYKENAMKLSRIHHDQPVKPLDRAVFWVEFVMRHKGAKHLRPASHDLNWFQYHSLDVIGFLLACVATVAFLVTKCCLFCCWKFGKTAKKKKRE

SEQ ID NO: 8330 - protein, 529 aa, Ceratotherium simum
MSMKWISVLLLLQLSCYFSPGSGGKVLVWPTEYSHWINMKIILDELVQRGHEVSVLTSSASILVDPSKPSAIKYEIYPTSLTKHDFEVLLRKLFDKWTYLPKDTFWTYFSQLQELLWEYFDCIEKLCKDVVLNKKLITKLQESRFDLLLADAVGPCGELLAELLKIPLVYSLRYIPGHKIEKYSGGLPFPPSYVPVISSELSDQMTFMERVKNMIYVLYFDFWFQTLNEKRWDQFYTEVLGRSTTLSELMGKAELWLIRTYWDFEFPRPLLPHFEFVGGLHCKPAKPLPKEMEEFAQSSGENGIVVFTLGSIVSNMTEERANVIASALAQIPQKVIWRLDGKKPDTLGPNTRVYKWIPQNDLLGHLKTKAFITHGGTNGIYEAIYHGIPMVGIPFFADQPDNIVHMKTKGAAVRLDFHTMSSTDLLNALKTVINDPSYKENAVKLSRIHHDQPVKPLDRAVFWIEFVMRHNGAKHLRPASHDLTWFQYHSLDVIGFLLACVATAVFVLAKCCLYCCRKFAKTGKKEKRE

SEQ ID NO: 8331 - protein, 531 aa, Mesocricetus auratus
MPAQWKSLLLLLLQITCYFRSANCGRVLVWPMEYSHWLNLKIILDELTERGHEVTVLRPSASIFLDPEKSPNLKFESFPSTLSKDDLDKSFLRLVNVWIYELPSDICLSYSPLLENLFQDISDSYLSLCKDTVSNKQLMTKLQKSKFDVIVSDAVAPCGELIAELLHIPFLYSLRFSPGYKVEKSSGGFIFPPSYVPIILSGLGGQMTFMERVRNMICMLYFDFWFQPLNEKKWDQFYSETLGRHTTLAETSGKAEMWLIRSYWDLDFPRPTLPNVDFVGGLHCKPAKPLPKEMEDFVQSSGEHGVVVFSLGSMVSNMTEAKANTIAWALAQIPQKVLWRFDGKTPDTLGSNTRVYKWLPQNDILGHPKTKAFVTHGGANGIYEAIHFGIPMIGIPLFGEQHDNIAYMVAKGAAVALNFRTMTRLDLLNALEAVIDNPFYKENAMWLSTIHNDQPMKPLDRAVFWIEFVMRHKGAKHLRPLAYNLTGYQYYSLDVIGFLVACVAVIAFLVIKSCLFIYQKFVKMGKKMKND

SEQ ID NO: 8332 - protein, 412 aa, Mandrillus leucophaeus
MSLKWTSVFLLLQLSCYFSSGSCGKVLVWPTEYSHWINMKTILEELVRRGHEVTVLTSSASTFVNDSKSSAIKFEVYPTSLTKNDMEDSLMKLIKNMIHKLYFDFWFQIHDIKKWDQFYSEVLGRPTTLFETMRKAEMWLIRTYWDFEFPRPFLPNVDFVGGLHCKPAKPLPKEMEEFVQSSGENGVVVFSLGSMISNLSEERANMIASALAQIPQKVLWKFDGKKPNTLGSNTRLYKWLPQNDLLGHPKTKAFITHGGTNGIYEAIYHGIPMVGIPLFADQHDNIVHMKVKGAALSVDIRTMSSRDLLNALKSVINEPIYKENAMRLSRIHHDQPMKPLDRAVFWIEFVMRHKGAKHLRVAAHNLTWIQYHSLDVIAFLLACVATVIFIITKCCLFCFRKLAKTGKKKKWD

SEQ ID NO: 8333 - protein, 529 aa, Mesocricetus auratus
MPVKWMSVLLMLQMSCYFRSGNCGKVLVWPMGHSHWMNLKIILDELAQRGHEVTVLRPSSSIFFDPKKSSGLIYETFPTASNNDEVEKFVSQWVNMWIYDVPKDTCWRYYPSMNIMFGKFSDLWLKFCREVVTNKQVMAKLKESKFDVVLSDAISPCGELIAELLQIPFVYSLRFGNGYGIEKYSAGLIFPPSYVPIVLSGLSGQMSFMERVENMVCLLYFDFLYESFPAKDWDPFFSEILGRPTTMADTMKKAEMWLIRSYWDLEFPRPSLPNIEFVGGLHCKPAKPLPEEMEEFAQSSGEHGVVVFSLGSMIRNITQERANTIASALAQIPQKVFWKFEGKKPDTLGANTRIFNWMPQNDLLGHPKTKAFVTHGGANGIYESIHHGIPMVGIPLFAEQHDNIAHMVAKGAAVSLDFHTLKSSDLLNALKAVINNPSYKKNVMWLSTIHHDQPMKPLDRAVFWIEFVMRHKGAKHLKPLAYNLTWYQYHSLDVIGFLLACVAAIAFFTIKCCLFVYRFFVKERKDKRD

SEQ ID NO: 8334 - protein, 417 aa, Colobus angolensis
MSMKWTSALLLIQLSCYLSSGSCGKVLVWPTEFSHWMNIKTILDELVHRGHEVTVLAYSTSILPGPNNPSALKFEICPTSLTETEFENDVTQLVKRWLDVQNMMYMVYFDFWFQVWDVKNWDQFYSEVLGRPTTVFETMAKAEIWLIRNYWDFQFPHPLLPNVEFVGGLHCKPAKPLPKEMEEFVQSSGENGIVVFSLGSMVSNMSEERANLIASALAKIPQKVLWRFDGNKPDALGLNTQLHKWLPQNDLLGHPKTRAFITHGGANGIYEAIYHGIPMVGIPLFADQPDNIAHMKAKGAAVSLDFDTMSSTDLLNALKTVINDPLYKENAMKLSSIHHDQPVTPLDRAVFWIEFVMRHKGAKHLWPAAHDLTWFQYHSLDVVGFLLACVAAVIFIITKCLVCVWKFVRTVEKGKRD

SEQ ID NO: 8335 - protein, 1053 aa, Drosophila virilis
MLRLMVWLGLGISAALCPSSVDSAQILGLFGHPGKSHFDFFRPMFVALAERGHNVSMYSYFPLKQPMANYTDYVFEGMPLLTDFVDLQTFERQSDRLLGQPFKVPTFFMLHDWGLRSCRVALNSPLIAQLLSSPQRYDVIILEHFSNDCLAAVAHLLDAPVIALSSCAIMPWHYKRMGTPFINPIMPMNFLTYTDQMSFVERLNNFFHFHIVNMLYNFITQPATDAMISQRFGFGLPPINEIVKNTSLMLINQHHALTGSRPYAANVVEVGGLQVGPAKPLPLHLERLFDASNLGVIYISWGSMVNPSTLPAGKLQALFDTISQLPGYTFVMRWTNQTLAENKPSNLHTYEWLPQRDLLCHPKVKAFLSHGGLLGTTESIYCAVPMLVTPFYGDQFLNAGAVVQRRFGVIVDFADFDEPHLTQALRTILQEGFAAEMKRSTLEFRERPLEPLKLAIWWIEHVIATSGAPLSQSVARHINWFVYNSIDVYVCCLTIALLGLAGVWKFCKLLKWAWGRRTTPKTKQPQLASFRHSFEIMLLLRPLLAALLTLLCVQVDAGRPLKVLGLFPHPGVSHFHFFQPIMHALAEAGHDVSVVSHFPAKNPPIRYKDFPLTGTEKLTNSVDLKFFEKRPFYNHFIEFFLLHEWGKEACNLTLRSEALQTVLKRKAGYYDVIVLEQFNTDCMMGVAHQLQAPVVALSSCAMMPWHYERMGVPIIPSYIPALFMGQSQDMNFGGRLANWFSFHTLNWLYKLVSIPAADALVQYKFGHDVPSVGELVKNTSVYFVNQHYSLSGPKPLPPNVIELGGLHIQKANPLSAELQRLLDNAEHGVILISWGSMIRANSLSPEKRDGIVRAVARLKQQVIWKWENETLANMPPNMHIMKWLPQRDILCHPNVKVFMTHAGLMGSSEAAYCGVPVVATPMYGDQFLNAAALVQRNMGVLLHYEDIGENTVLKALKRALDKKHADAAKLVAHSFKYRPQQALQTALWWVEHVGHTGGNPLLKSSAVELSRFVYYSLDCYVAVGLILAIVIASWVALIGRCRAKRPEQKNKRD

SEQ ID NO: 8336 - protein, 397 aa, Ochotona princeps
MCVKRVSIWLLLLQLSSCFSSGSCGKVLVWPMEFSHWLNLKIILGELVQRGHEVTVLRSSASVSIDPKNESGIKFETFPTSSTKEEMGTFFMYWINTLINDVPRDNYLEYYPLWNKFFLEFSDIYESLCKEVVFNKKLIAKLQASKFDIVVSDPFAPCGELLAELLEIPLVYSLRFTPGYTYEKYSGGLLCPPSYVPVIMSVLSGKMTFMERVKNMLFMLYFDFWFQTFNEKRWDQLCSEALGRPVTFSELMGKADMWLIRSYWDLEFPRPLLPNVEFVGGLHCKPAKPLPKDMEDFVQSSGEEGVVVFSLGSMISNMTEERANVIASALAQLPQKVLWRFDGKKPDTLGSNTQVYKWIPQNDLLGHPKTKAFVTHGGANGIYEAIYHGIPMQFYWQ

SEQ ID NO: 8337 - protein, 423 aa, Capitella teleta
MLENPDPGILTGIVAPAVTKECELFLKDDSLLKQAKEVNFDLAVVDGLFFARCLYLFPVKLGIPYVTITTFQEFWMMKVPAMPSHVPFHYLGFTQKMTFMQRMINTLVNIAWVVGSHKFSELPGVIKDRYSDVIAREDFDSLILKSKLWFFNSDISIDYPKPSMPNVINIGGMSPKPAKALEEDLGKWMDESTNGVIFASFGSVISHIPLELSNKLLTAFAQLPYNVLWRNKNITGLTIPDNVRPMSWVPQNDVLGHPNTVAFITHCGNSGQFEALYHMVPMIGMPVFADQPYNSLRMEQKGFGIHMDLRTFKPEELTQNIIRVVTEPSFRTNITKGSGIFKSRQRKLKDIITFWVEHVIEHGADHLRSYAMDMPAYQYLLLDVFAVLFLVAFLMFAIILLLCRVACKKISQLFQGDKKEKNE

SEQ ID NO: 8338 - protein, 446 aa, Alligator sinensis
MLARWFPLLLCVQMCFWDSGSCGKVLVWPTDASHWINLKMILGELILRGHDVTVLVPSATLLIDYDDPTSPFDFEVLKVPFTKETVKTVLQDFLSLCLYEKPHLSHWEALVKIRQMMTTFTKMSKQTCDGFVLNPKLITKLRHGGFDVLISDPLAPGGRPTTLCETMGKAEMWLIRTYWDFEFPRPYLPNFEFVGGLHCQPAKPLPEEMEEFVQSSGEHGIVVFSLGSMIHNLTDEKNNMIATALSQLPQKVLWRYKGKKPETLGTNTRIYDWIPQNDLLGHAKTKAFITHGGTNGIYEAIYHGVPMVGIPIFADQPDNIAHMRAKGMAVELDFNTMKAQDLVDAVNMVVNNFTYKENAIRLSQIHHDQLVKPLDRAVFWIEFVMRHKGAKHLRPAAHQLTWYQYHCLDVLAFLLTCATVTLFIAVKCCLFCCKKCGRIVRKRKTE

SEQ ID NO: 8339 - protein, 542 aa, Callorhinchus milii
MQRAMKLYFQILTLLWCSVEISKAAKIVVVPPIMFESHLYIFKTLAKALHEQGHETVFAVSEGREIPSSDYFRLLRYPGFFNSTTADEFLQSKMRNIFSGRLTALELFDILEHYSKNCDLMVGSQGFITQLKEEKFDLVLVDPNEMCGFVIGHLLEVKYAVFSTGLWYPAEVGAPTPLAYVPEFNSLLTDKMNLFQRITNTAVYLLSRFGVNFLFLPKYERIMQKYNIEPERSMYELIQGASLWMLCTDVALEFPRPTLPNVVYVGGILTKPASPLPEDFMTWADDAEEEGFVLVSFGAGVKYLSDDVAHKLAGALARLPQKVVWRYSGKKPSNLGNNTRLVEWMPQNDLLGHSNIKGFLSHGGLNGIFEAMYHGVPVVGIPLFGDHYDTMTRVHAKGMGISLNWKTMTEDDLYNAMVTVIKDPRYKQRAEQMSQIHRDQPGHPVSRTVYWINYILRYSGAEHLRAAVYNIRFYQYFLLDAALLVSLSVVVTYKIGLWIVKLISKRFSSKVLQGKTNGHCYNGIANGKHRKNGHVKHEKKVK

SEQ ID NO: 8340 - protein, 484 aa, Colobus angolensis
MLNNILLFSVQISLIGITLGGNVLIWPMEGSHCLNVKIIIDELIEKEHNVTLLVASGSLFITPTSNLSLTFEIYKVPSGHLRLEELIQDFVLAELLNRPSKNTFWLYFSEMQEITWRFGDIIRNFCKDVVSNKKLMKKLQESRFDVVFADPTFPCSELLAELFNIPLVYSLRFIPGYVFEKHCGGFLFPPSYVPAFMSELSDQMTFMERVKNMIYMLYFDFCYQMHDMKKWDQFYSEVLGRPTTLCETMGKADIWLIRNSWNFQFPHPLLPNVDFVGGLHCKPVKPLPKVLWRFDGNKPDTLGLNTRLYKWIPQNDLLGHPKTRAFITHGGANGIYEAIYHGVPMVGIPLFADQPDNIAHMKARGAAVQLDFDTMSSTDLANALKTVINDPLYKENVMKLSRIQHDQPVKPLDRAVFWIEFVMRHKGAKHLRVAAHDLTWFQYHSLDVIGFLLACVATVIFIIMKCCLFCFWKFTRKGKKGKSD

SEQ ID NO: 8341 - protein, 528 aa, Ceratotherium simum
MVSEKWALAVLLLQLCCTGCGYCGKVLVWPCDMSHWLNVKTILEELTERGHEVTVLTPPYTNLIDYKKSSPLNFEVFHLPYDKESAENLNNKFLDLIFNVLPNLTPWQSAIKLKDYFAEITESLKIMCESVVYNQTLMKKLQESNYNVMIIEPVIPCGELVAELLAVPFVLTLRDSIGGMREKHCGKLPAPSSYVPVHMVGLTDRMTFMERVKNTMLSVFFDFWIQDYDTDIWDQFYSEALGRPTTLCETLGRAEIWLIRTYWDFEFPRPYLPNFEFVGGLHCKAAKTLPKKIEEFVQNSDGIVVFSLGTMIQNLTEEKANLIASALAQIPQKVLWRYKGKKPATLGANTQLYDWIPQNDLLGHPKTKAFLTHGGINGIYEAIYHGVPMVGIPMFGDQHDNIIHMKAKGVAVELNMNTMTSADLLSALRTVINDPSYKENAMKLSRIHHDQPVKPLDRAVFWIEFVMRHKGAKHLRPTAHNLTWFQYHSLDVIGFLLACAATAVFLVTKCFLFFCRKLDKTGNKKKRE

SEQ ID NO: 8342 - protein, 530 aa, Otolemur garnettii
MAVKWTSALLLLQLSCCFSSGTCGKVLVWPMEFSHWMNIKTILDELVQRGHEVTVLASSASIIVDPRKTSAIKFEVYPTSLTKDGLESLFLRLVDEWIYDVPKDSFWSHFSKVEEIMWAYSDKYQKLCEDVVFNKKLMKKLQDAKFDVVLADAVGPGGELLAKILKTPLVFSLRYSPGYGLEKHSGGLPFPPSYVPVMLSELSDRMTFMERVKNMIYVLYFDFWFQTFNMKKWDQFYSDVLGRPATLYELMGEADIWLLRTYWDFEFPHPILPNVEFVGGLHCKPAKPLPKEMEDFVQSSGENGVVVFSLGSMVSNMKEERANVIAAALAQLPQKLLWRFDGKKPDTLGPNTRLYKRIPQNDLLGHPKTKVFVTHGGANGIYEAIYHGVPMVGIPLFADQPNNMAHMRAKGAAVTLDFTTMSSADLLSALKTVTNDPIYKENAVRLSKIHHDRPVKPLDRAVFWIEFVMRHRGAKHLRVAAHDLSWAQYHSLDVIGFLLACGAAVMFVLTKCCLLCYRKFAAQRKKGKQE

SEQ ID NO: 8343 - protein, 576 aa, Aquila chrysaetos
MSIVLCSDMPSCQAWISLLLAGSKVFAHWSSELLPARSDRSCTLTAEMMGPRFPWLLWAYACCWSAGFCGKVVVWPTDASHWINVKVLLEELVLRGHEVTVLVPSSNLLIDYQDTSSPFTFEVLQVPFTQKTLHAIMDDFLNFWMNEVSNLSLWKIMWRMKEDLEVFTNMSKQTCDTLVMNPQLIAKLQQAKFDVLVADPLSVGGELVAEILAIPFVYSFRFSDGNVVEKLCGGLPSPPSYVPASTRGLTDQMSFMERLQNFLFYFYMDLFFLKFWRDEWDGYYSNVLGRPTTLCETMGKAEIWLIRTYWDFEFPRPFLPNFEFVGGLHCQPAKPLPKEMEEFVQSSGKHGIVVFSLGSMVYNLTDEKSNVIARALSQLPQKVLWRYKGRKPETLGSNTRLYDWIPQNDLLGHPMTKAFNTHGGTNGIYEAIYHGIPMVGIPMFADQHDNIAHMRAKGAAVELDFSTLKTQDLVDALNTVINNSTYKENALRLSKIHHDQPVKPLDRAVFWIEFVMRHKGAKHLRPAAHHLTWYQYHCLDVLAFLFTSTAIAVFTLVKCCLFCCRTCSRIAKRKKE

SEQ ID NO: 8344 - protein, 543 aa, Clupea harengus
MKPFPAITTLLLLSFFNWSWAAKIVVVPPIMFESHLYIFKTLATALHAEGHDTVFLVSEGRDVPESEHYRFQRYPGIFNSSTADDFLQSKVRNIFSGRLTALELFDILDHYSQNCDAVVGSEAVMAQMKRENFDLLLVDPNEMCGFVLAHILGVPYAVFSTGLWYPAEVGAPAPLSYVPEFNSLLTDRMTFLQRVTNTAVYLVSRFGVQFLVLPKYDRIMKKHNIQPAVSMHELVQSSRLWMLCTDMALEFPRPTLPHVVYVGGILTKPPSPLPQEFDDWVKDTDKHGFVVVSFGAGVKYLSEDIAHKLAGALAQLPQKVIWRFSGVPPSNLGNNTKLVDWMPQNDLLGHKNTRAFLSHGGLNSIYEAMYHGVPVVGVPLFGDHYDTMTRVQAKGMGLMLEWKRMSEQDLHTAMLSIITDNRYRDRAHMLSNIHKDQPGHPVSRAVYWINYILRHNGAPHLQSSVYSISTYQYFLLDVVAVMATAMLLIGYCLYRTGRAIRARFWKGAESEMMAKENGHCHNGIPNGKLKRNGHIKSNDKKLK

SEQ ID NO: 8345 - protein, 393 aa, Aotus nancymaae
MVRNSKRYILVTFFKDAVSPCGELLAELLKIPFVYSLRFSLGYILEKHCGGFLLPPSYAPVVTSELSDQMTFMERVKNMIYVLYFRFWFQLFDMKKWDQLYSEVLRRPTTLFEIMGKAEIWLIRNYWDFQFPHPRLPNVEFVGGLHCKPAKSLPKEMEDFVQSSGENGIVVFSLGSMISNMTEERANVIASALAKIPQKVLWRFDGNKPDTLGHNTRLYKWIPQNDLLGHPKTKAFITHGGANGIYEAIYHGIPMVGVPMFADQPDNIAHMKVKGAAVGLDFDTMSSTDLLNALTTVINDPIYKENAMKLSRIHHDQPMKPLDRAVFWIEFVMRHKGAKHLRVAAHDLTWFQYHSLDVIGFLLACVTTVIFIITKCLFCVWKFVRTEEKGKKD

SEQ ID NO: 8346 - protein, 320 aa, Lissorhoptrus oryzophilus
TLLRILPSGFDKYTVVPINDAMVKKYLGSDIPSVSTLQKYLSMIFVNSNPFLTNVKPVPPSVITLGFMHIKPPKPLPQELQEVLNNSTQGFVYFSLGSNAGFGDFPESTRNEVIQALSELPYTVLIKWNLDTFPNLGKNIITKKWFPQQDILAHPNIKLFVTQGGQQSTEEAISRGVPLVGIPVLADQLPNIKMLVKHGVAVLVRPNELTFTSLSNAIKEVAENPKYRKKMQEIQRVAFDQPMTSVEKAVFWSEYVIRNKGAPYLRSFLADTPLYEYLMLDVLALLLSFLLIVVFIIYQLLRITKKMLTSPGSKMKHKSH

SEQ ID NO: 8347 - protein, 411 aa, Nomascus leucogenys
MSMKWTSALLLIQLSCYFSSGSCGKVLVWPTEFSHWMNIKTILDELVQRGHEVTVLASSASISFDPNSPSTLKFEVYPISLTKTEFEDIIKQLVKRWADLPKDTFWFQMFDMKKWDQFYSEVLGRPTTLSETMAKAEIWLIRNYWDFQFPHPVLPNVEFVGGLHCKPAKPLPKEMEEFVQSSGENGIVVFSLGSMVSNTSEERANVIASALAKIPQKVLWRFDGNKPDTLGPNTRLYKWIPQNDLLGHPKTRAFITHGGANGVYEAIYHGIPMVGVPLFADQPDNIAHMKAKGAAVSLDFNTMSSTDLLNALKTVINDPLYKENAMKLSRIHHDQPVKPLDRAVFWIEFVMRHKGAKHLRVAAHDLTWFQYHSLDVIGFLLTCVATVIFIITKCLFCVWKFVRTGKKGKRD

SEQ ID NO: 8348 - protein, 525 aa, Spodoptera litura
MLGILKLGFVLTLATFCETANILYAIPYSVKSHYIMQRPVGLELARRGHNVTVITAHREIDHPPNYHQVIVVNKTIWDVLGRERPNLFTLVEYSAEQLHKEILWKGGLALTEGSLKSAEVQSLLAENRTFDLVISELFFQEATYALAHKYNAPLILISTMVNCMKHSLLTGNPLELATTSFEFLDASNPTSFWGRLRNLYLNVYDYFWWRYWFLEKQEELVRKYIPNLPQPVPSLYDLEKNASLLFLNSHFSFQSPVAFLPNIIEIGGIHLKESDSQLPADLQKLLDEATEGVVYVNFGSNVRSTELPIEKKNALINVFKRLNQTVLWKWEAESLDEKPDNVVVRKWMPQKEILSHPNIKVFLSHGGLIGTLEAVFHGVPIIGIPVYGDQYKNLIKAEEAGTGTTLLYHDINEENLERILHEFLKDDSYLKRAKELSRRFKDRPMSPLDTAMYWIEYVIRNKGADHIKSPSLKMNWITYNMLDVYGFIVIIFSLCSYVIYKIWELVSQCKFLVRIGFGHRKLKCL

SEQ ID NO: 8349 - protein, 1011 aa, Ctenocephalides felis
MAMASPSHHIWNKAIMQTLASNGHNVTALSIDTDETSGPNIHYLKINGVYESLYSGDEPFDLLEFSKKSLIGITVDTAKWFLTVCRASLRSEGVQRLLEYPKDFKFDLVIFDYTNLPCLHGFVSRFNSPPQIGITAFANPPHTSDLVGSPNFVSLKPHYTTTMGSTMSFLERLYNSLLYSVELVQRRMLIWWVRNEVREVFGDDELDVGALEKEVELVMVNSHPGMDVPEPVLPNVIQVGGLQIKEPKALPEDLKRFLESSKKGSVLFSLGTNMKSEIIGEEKISMFINAISRFPEYNFLWKIELENRTFPKNLMVRKWLPQNNVLAHPNIKLFITHGGLLSSQESTWHGVPIIGMPFFVDQHTNVQKSVDAGVGEKLDFFQLTEEIVYQKIKMILENTSYRQKMALRSSRFRDRPMHPLQEATWWCEYVLRHNGAPHLKSLAAVMEAPALFMWDLMLVWLGIFLGVAFLVVFGLRKIFRRKEVTNIRRKEFEEKKIVKKSETKFKGNILCLMTIASPSHHIWNRSLMEALAAKGYNITALSVDIDKEPAANLHYILIEDVYKAIYEEENFDLIAYASLDIYSSISDLMKYFAISNRAILRSQGLQTLLRYPDDFHFDLVVYDYSSFPSILGILQKFHNPPVVGVSAFMNPPNTYDASGNPIFASLKPYYATTFTPVMNFWERSVNLFYYVVDNWARKKDVEDAQELMEKVFGKSAGNARELERRIELFLVNVHPSIDVPEPLLPNVIPVGGLQVKQPKEAPQDIKRFIESSKKGAVLFSLGSNVKSEMLGEERIRMFIKAFAKFPDYHFLWKFSNKEKLNLPKNVLLQDWMPQNDILGHPKTVLFMTHGGLLSTQESHWHGVPMLGIPFFADQHTNMKRSIDAGVAEKLDIFNLSEEAIIAKLSRMLSEPSYQEKMTIRSTLFRDRPQHPLQEAVWWCEYVLRHKGAPHLKSQAVSMCPFALFMWDLLLVWLGVFLGALFLVFYGIKKICCGKEKDLKASEVLRKVKKTN

SEQ ID NO: 8350 - protein, 528 aa, Aotus nancymaae
MSMKWTSVLLLIQLSCYFSSGSCGKVLVWPTEFSHWMNIKTILYELVQRGHEVTVLAYSPSFLFDSNNSSALKFEVCSTSLAETEFVDNIIHLIERWSEIPKDTFWSHFSKLQEIMWTYSDLIRTFCKDVVSNKKLMTKLQDSRFDVVLADAVSPCGELLAELLKIPFVYSLRFSLGYILEKHCGGFLLPPSYAPVVTSELSDQMTFMERVKNMIYVLYFRFWFQLFDMKKWDQLYSEVLRRPTTLFEIMGKAEIWLIRNYWDFQFPHPRLPNVEFVGGLHCKPAKSLPKEMEDFVQSSGENGIVVFSLGSMISNMTEERANVIASALAKIPQKVLWRFDGNKPDTLGHNTRLYKWIPQNDLLGHPKTKAFITHGGANGIYEAIYHGIPMVGVPMFADQPDNIAHMKVKGAAVGLDFDTMSSTDLLNALTTVINDPIYKENAMKLSRIHHDQPMKPLDRAVFWIEFVMRHKGAKHLRVAAHDLTWFQYHSLDVIGFLLACVTTVIFIITKCLFCVWKFVRTEEKGKKD

SEQ ID NO: 8351 - protein, 486 aa, Ochotona princeps
MSVKCLSLMLLLQLSCYFSSGSCGKVLVWPMEFSHWMNLKTILDELVQRGHEVTVLKSSASVVINAKNETGIKFETFPTSYTKDELETFFGYWINKWLYGISADKYWEYFPALAEFTLKFSDIFEKFCKEVVLNKKLMTKLQEARFDVVVADPISPGGELLAELLKSPLVYSLRGFPGYVLEKHGGGLLFPPSYVPVILSQLSGKMTFMERVTNMLCMLYFDFWFPKLNEKRWDQFYTETLGRPATYFEIMGKADMWLIRSYWDLEFPRPLLPNFEFIGGFHCKPAKPLPEVLWRFEGKKPDTLGPNTRLYSWIPQNDVLGHPKTKAFVTHGGANGVFEAIYHGVPMVGLPLFGDQLDNILHMKAKGAAIKLNWKTMSSAELLNALKTVINDPSYKENVMTLSRIHHDQPMKPLDRAVFWIEHVMRHKGAKHLRVAAYDLTWYQYHSLDVIGFLLACVTIITYLVIKSCLLLYQKLVKMGKKEKRN

SEQ ID NO: 8352 - protein, 382 aa, Branchiostoma floridae
CEALVYDNKMISQLRQMNFDIIIIDPAMVCGNIVARLLNIPLVIIEAPYIMPGFLEYATQAPVPIATFYSFRTDFWQRLKNLVWHCVAGAIMRTFAGRFRPIASRALGYDTTILELMAEADLFLMRGDFVMHPPHPAMPNMVYIGGYHVQRVNPLPKDLEKFLEESGGVVVLSFGSYAKVMGKEKAEMLAAGLARVPFKVIWKFQGQRPKNTGENTLLMSWIPQNDLLAHPKTLLFITHCGINAVYEAMFHGVPMVRVPAFAEQHGNSDNLETLGTGVTLDIFTMTSDDLYEAIMEVANNKTYKSAAVRLAQLQRDQPQSPMDRAVWWIEHVIRHGGLPHLKSAARHLSLLQYHLLDVAALLSAAGVAMVLVLWLCCRCCCR

SEQ ID NO: 8353 - protein, 709 aa, Pristionchus pacificus
MRLELLCLISIAQSYKILVYNIRYSHSHSNFIGNVADILVEAGHDVTSLIPTISNGKDGTVKSKIIYVEGSEEAKKGLVSMLDGPSFLELGESNLLRMGFALAPVFAAQCERTLEEKELIEQLKNKNYDVYIVENSDMCGMALSELIKPKSIIMTVTSALYGHQYEEVGVPQPLSYNPCEIGFREPRKLVHEIFRRRFGDDFPSFEQITSRIAYCFTNTEPLIDFATPTINRVIPLGGLGAKAPKELDEHWQRVLSLRPRSVLLSFGSMVRSANLRLDVKRAFLKTMVAFPDVTFIWKYETPSDEFAVDEAAKVENLVLTEWMPQNDLLSHDGLAVFITHGGMGSTQETALRGVPALFVPIFADQPRNAGGMAWNRLGKVLNKFHLHDHTIIIAHLKELLENDEYRANARRTSRMLAAKPFSSRDQLIKYTEFAAEFACDLSKHSMAAAPFLAKATGILVQTGKVAAMGGAAAIGTAVLGGVSVAVAGGLAIGQALIERDTEIKKEKIRVELEVEQVKADLKQKELQAEVELKKLSVEQAVAECEAGKDAAVAAVRLEAAKEQETVLREAEERHREEQEALAAQAQAAADLLKAQNADQAAMLAFVQEQRINELNAHNNDLKNIIASTNTMFGAVFTELTGIIGVQSAHITRLQEDLRARTPVAIEGMLIELLSLFLKLYTAAVDVIVLRGNEGVPSAFDSSGSGGALM

SEQ ID NO: 8354 - protein, 529 aa, Rattus norvegicus
MPQKWISALLLLQISFCFRSGNCGKVLVWPLEYSHWMNLKIILDELVQRGHEVTVLRPSSSVFLDPKKASGLVYETFPTTSNNDEVEKFFTQWVNTWTYDVPKYTCLRYYPSLNKMFGQFSDLWLQLCREVVSNKHLMAKLKESQFDVVLSDAVGPCGELIAEILQLPFVYSLRFGIGYGIEKYSAGQPFPPSYVPIILSGLSGQMTFMERVENMLCLLYFDFWFESFPAKDWDPFFSEILGRPTTMVDTMKKAEIWLIRSYWDLEFPRPSLPNIEFVGGLHCQPAKPLPKEMEDFAQSSGEHGVVVFSLGSMIRNITQERANTIASALAQIPQKVFWRFEGKKPDTLGPNTRVFKWIPQNDLLGHPKTKAFVTHGGANGIYESIHHGIPMVGIPLFAEQRDNVAHMVAKGAAVSLDFHTMSSSDLLNALKAVINKPSYKKKVMWLSAIHHDQPLKPLDRAVFWIEFVMRHKGAKHLRPLAHNLAWYQYHSLDVIGFLLACVLAIVLLAVKCCLFLYRFFVKVAKNKRD

SEQ ID NO: 8355 - protein, 398 aa, Cyprinodon variegatus
MLQFVSGAQVPKNGHLPYKGIKTFTFILQYIHRPLYQDYFTQIRAHNVERHCAQLPAPPSYVPAAMSSLTDKMDFPQRMGNVLFYALQDFLLEQFMWKEFDKYYSEVRGTPTSACKMMGNADFWLLRTYWDFDFPRPSLPNIKFVGGIHCKPAKPLPKEMEEFVQSSGDAGIVVFSLGTVVKNLTTDKANMIASALAQIPQKVLWRYSGEKPQTLGPNTRLYDWIPQNDLLGHPKTRAFVTHGGTNGIYEAIYHGVPMVGIPIFGDQPENMVHVETKGAAVTVNLNSLNADELRDAVNTVINNKSYKENVMRLSRINHDRPMSPRDEAVFWIEFTMRNKGAKHLRVQSHDLTWYQYHSLDVITFFIILDLLLLIILLKTCSFCFKRCCGRKTTKRKAE

SEQ ID NO: 8356 - protein, 532 aa, Esox lucius
MVSVRRPLLYGALLLLYLYPLTQGGNVLVFPGEHSHWLNMRTILDELVDRNHNVTVLVCTASPSIDYSRSERYHFHVYDVPFDRQHLKSVNDRFIEFWMYDAQNASVLQIGLEIRDLMQKMNVIQLSVCDAILRDQALMESLRRVKFDVLLADPMLMCSDLLADVLDLPLVLSIRFSFGLVLERQCGQMPAPSSYVPSPPLAYTDQMSFFERVQNFAMYFFNDVLMYVHCLTTVNSYYSEIKGTPTTFCEIMGKADIWLIRTYWDFEYPRPFLPNFKFVGGLHCKPAKPLPAAMEEFVQSSGDDGIVVFSLGSMVKNLTKERGNTIASALGQIPQKVLWRYAGVKPETLAPNTRLYDWIPQNDLLGHPKTKAFITHGGTNGLYEAIYHGVPMVGVPLFADQPDNIMHMKTKGAAVMLDFNKMTSQDLVDGLNSVINDPTYKENMMRLSRIHHDQPMKPLDTAVFWIEFVMRNKGAKHLRVESHNLSWYQYHCLDVAAALLSVVGLITVVTVKTCTFFLRKCFRKAKARQKTE

SEQ ID NO: 8357 - protein, 696 aa, Cavia porcellus
MSVKLTVFLLLLQLNSYFDSGSCGKVLVWPMEFSHWINLKTILDVLVQKGHEVTVLRPSTSISYHVEKESAIKFEDYPASLSASDWEYIFTEGLRKVIYELPKESIWTYFSTLQEIMWEETDYLKTLCEDVVRNKNLMSKLQESRFDVILADDFIPCGDLIAELLNLPFVYTHRFFPGYTYEKYGGGLSVPPSYVPVGLSELNDQMTFLERVKNMIYVLYFDFWFQTFNEKKWNQFYSEVLDGNHWINIKTILDALVQKGHEVTVLRPSISISFYVEKESAIKFEDYPTSLSASYWEYIFTEGLRKMIYELPKESVWTYFSTMQKITWEDSDYLKTLCEDIVQNKELMSKLQESRFDVILADSLVAGGDLIAELLNIPLVYTHRFFPGNTYEKYSGGLSYPPSYVPVAFSELSDQMTFMERVKHMIYVLYFDFWFQMFNEKKWNQFYSEVLGRPTTLTETMGKADVWLIRTYWDLEFPRPSLPNFDFIGGLHCKPAKPLPKVVWRYDGKKPATLGPNTLLYKWIPQNDLLGHPKTKAFITHGGTNGIYEAIYHGIPMVGIPLFGDQADNIVHLKAKGAAVRLNFITMSSTDLVNAVNTVINDPSYKENAMRLSRIHHDQPVKPLDRAVFWIEFVMRHKGAKHLRVAAHDLSWFQYHSLDVIVFLLASVATVIFIITKCCLFCCHKFAKTGKRKKRE

SEQ ID NO: 8358 - protein, 510 aa, Podiceps cristatus
VLWLLAVLGWGSGGKVLVWPADNSHWLNMEYILQELVIRGHEVTVLLPSCFLILDPTQPSPFQFEVVEVPVTKKEMATLLEEAFYFWFYQEKVLPVWESFYKISQLMYKLKNATKIICDEVLKNGALLERLRTSTFDVLLADPLVPSGELVAEKLGIPFVYTIRFSIGNTLERHCGTLPAPPSYVPAILSHLTDRMSFLERLKNIFTYAIQDIIYHYLLWGSWDQYYSDVLGRPTTLCETMGKAEIWLIRTYWDFEFPRPFLPNFEFVGGLHCQPAKPLPKEMEEFVQSSGEHGIVVLSFGSMVYNLTDEKSNVIARALSQLPQKVLWRYKGKKPETLGSNTRIYDWIPQNDLLGHPLTKAFITHGGTNGIYEAIYHGIPMVGIPMFADQHDNIAHMRAKGAAVELDFSTLKMQDLVDALNTVINNSTYKENALRLSKIHHDQPVKPLDRAVFWIEFVMRHKGAKHLRPAAHHLTWYQYHCLDVLAFLLTCAAIAVFILVKCCLFCCRRC

SEQ ID NO: 8359 - protein, 491 aa, Cricetulus griseus
MSVKIIAALLLLQLSGFFGPVSGGKVLVWPVEFSHWLNLKTILDELVKKGHEVIVLRPSVSFSYEVEDTSAIEFETYPTTYDMDGLEEFFIESINKYIYELPKLSFWRYFLMLQELFLLESEYSESLCKDVVLNKELMTKLQNSSFDVILADPFLPCGDLLAEILKTPLVFSLRFFPGSTYVKYSGGLPLPPSYVPPAMSELSDRMTFMERVQNVLYVLCFDFWFQTFNEKKWNQLYTEVLGRPTTLLEIMGKADIWLIRTYWDLEFPHPVLPNFDFVGGLHCRPAKPLPKEIEDFVLWRFEGKKPDTLGSNTQLYKWIPQNDLLGHPKTKAFITHGGTNGIYEAIYHGVPVVGIPLFTDQFDNVVHMKTKGAGMRLDFLTMSSTDLFNAVKTVTTDPSYKENAMRLSRIHHDQPVKPLDRAVFWVEYVMRNKGAKHLRVAAHDLTWFQYHSLDVLGFLLACVVTVIFIITKCCLFCCQKFAKGGKKKKRE

SEQ ID NO: 8360 - protein, 530 aa, Ceratotherium simum
MSMKWISVLLLLQLGCYFSPGNGGKVLVWPIEYSHWINMKTILDELVQRGHEVTVLTSSASILIDTNKPSAIKFEIYPTSLTKHDFEVLFKKMIHRLTYDLPKATFWTYFSLMREIFWEFSDCFEKFCKNLVLNKKLITKLQESGFDLLLADAIGPCGELLAELLKITLVYSLRFSPGYQIEKYSGGLPIPPSYVPVVMSELSDQMTFVERVKNMMYVLYFDFWFQTFNEKKWDEFYTEILGRPTTLSELRRKAEMWLIRTYWDFEFPRPLLPHFEFVGGLHCKPAKPLPKEMEEFAQSSGENGIVVFTLGSMISNMTEERANVIASALAQIPQKVIWRFDGKKPDTVGPNTRLYKWIPQNDLLGHPKTKAFITHGGTNGIYEAIYHGIPMLGLPLFADQPDNIAHMKAKGAAVRLDFNTISSTDLLNALKTVINDPSYKENAMKLSKIQHDQPVKPLDRAVFWIEFVMRHKGAKHLRPASHDLTWFQYHSLDVLGFLLACVGTAIFVITKCCLFCCQKFAKTERKEKRE

SEQ ID NO: 8361 - protein, 530 aa, Rattus norvegicus
MSVKMTAALLLLHLTIFFGSGSGGKVLVWPVEFSHWLNLKIILSELVKKGHEVVVLKPSVSFSYEVDKTSAIEFESFPSSYSIADVEVIFMDCVNESIYELPKQSFWGYFLMLQKLFERTSDYSERLCRDAAFNKELMTKLQNSGFDVILADPFTPCGDLLAEILKIPLVYSLRFFPGSTYEKYSGGLPMPPSYVPIAMSELSDRMTFVERVKHMIYVLCFDFWFQVFDEKKWNELYTEVLGRPTTLSETMAKADIWLIRTYWDLEFPHPVLPNFDFVGGLHCRPAKPLPKEIEDFVQSSGEHGVVVFSLGSMVGSLTEERANVIAAGLAQIPQKVLWRFEGKKPETLGSNTRLYKWIPQNDLLGHPKTRAFITHGGTNGIYEAIYHGIPVVGIPLFGDQKDNIVHLKTKGAAVRLDFLTMSSTDLLTALRTVTNDPSYKENAMRLSRIHHDQPVKPLDRAVFWIEFVMRHKGAKHLRVAGHDLSWVQYHSLDVIGFLLACVVTVMFILKKCCLFCCQKFTKAGRKKKKE

SEQ ID NO: 8362 - protein, 529 aa, Ochotona princeps
MSLKQVSVLLLLLQLSCCFRSGNCGKVLVWPMEYSLWLNLNVILDELVRRGHEVIVLRNSASIFLDPSKHTGIKFETFPIDATKADSEAFFVQLVTTWTNALQDPYWEYLPALQKLFSGYSDDREFLCKAAVLNKKLMRKLQESKFDIIISDTFGPCGELLAELLKIPFVYSLRFSPGYTMEKYSGGLSLPPSYVPMMLSDLSGQMTFMERVKNMLFMLYFDFWFQTFNEKRWDQFCSEVLGRPVTFYELVAKADMWLIRSYWDLEFPRPTLPNVHFVGGLHCKPAKPLPKDMEDFVQSSGEEGVVVFSLGSMVSNMTEERANVIASALAQLPQKVLWRFDGKKPETLGPNTQIYKWIPQNDLLGHPKTRAFVTHGGANGIYEAIYHGVPMVGLPLFADQPDNIAHMTAKGAAVRLNWKTMSSADLLNALRTVIHDPSYKENVMMLSRIHHDQPMKPLDRAAFWIEHVMRHKGAKHLRVAAHDLTWYQYHSLDVIGFLLACVTITTYLVIKICLSVYQKLVKTEKKKSD

SEQ ID NO: 8363 - protein, 530 aa, Loxodonta africana
MSMKWISVLLLIQLSCCFSCGTCGKVLVWPPEYSHWMNMKTIVDELIQRGHEVTVLTPSASVLIDPNKPSAIKFEVYPTSLTEDEFEYVFMKLVRRWTNEVPKDTFWTCFSVLQEILSEFSDFMERLCKDVVFNKKFMMKLQESRFDVILTDAVFPCGELLAELLNIPFVYTVRFTTGYTVEKYNGGLLTPPSYVPIVMSELPDRMTFMERVKNMIYVLYFDFWFQFFNEKKWDQFYSEVLGRPTTFSETRGKAEIWLVRNYWDFQFPRPFLPHFHFVGGLHCKPANPLPKEIEEFVQSSGKHGVVVFTLGSMVSNLTEERANMIASALAQIPQKVLWRFDGKRPDTLGPNTWLYKWIPQNDLLGHPKTKAFITHGGANGIYEAIYHGIPMVGIPLFADQPDNIAHMKVMGAAVRLNMDTMTSTDLFNALKTVIYDPSYKENAMRLSAIHRDQPVKPLDRAAFWIEFVMRHKGAKHLRPAALSLTWYQYHSLDVIGFLLACVAIVSFLVIKCCLLGYQKFYKTRKKKKRE

SEQ ID NO: 8364 - protein, 531 aa, Heterocephalus glaber
MMSMKWTSALLLLQMSFYFNSGSCGKVLVWPMDYSHWMNIKNILEELIQRRHEVTVLRPSSFIFVDINSSSGIKFETFTTSASRDDWEKYFTKWITTWMNLGSISSCFAYFPEVEKIFKEFSDTWQNLCKETVSNKILMNKLQESRFDVLLADPIAPCGELVAELLKIPFVYTLRASPGFQLEKFGGGLILPPSYVPVVMSGLGGQMTFMERVKNMICMLYFDFWVEMLNEKKWNQLYSEVLGKRTTIYDTTAKAEMWLIRSYWDLEFPHPSLPNFDFVGGLHCKPAKPLPKEMEDFVQSSGEHGVVVFSLGSMVSNMTTERANMIASALAQIPQKVLWRFDGKKPDTLGPNTRLYKWLPQNDLLGHPNTRAFVTHGGANGIYEAIYHGIPMVGIPLFAEQHDNIAHMKAKGAAVKVEFITLSSTELLNALDTVLNNTSYKENAMWLSTIHHDQPVKPLDRAVFWIEFVMRHKGAKHLRPLAQNLTWYQYHSLDVIGFLLACVATVTFLVIKSCLFCSQKFVKKGKKQKRE

SEQ ID NO: 8365 - protein, 502 aa, Branchiostoma floridae
MFNSHWMVAASIGQALVDKGHTVSVIVEEDIVEKRRAERPDFTFETFQDDGFGSRLRQFQDDVFRMAEPLFNYDELRQSRKVSDWARKHCEYLLGQGGQDSDLLARLKTAQYNVVISDYYLRCGSIVAAYLEIPHIANSPDGGRFFDEIVTGVPLPLAYVPSVESGFTDQMTFLQRVENACLENACRSSVSIMRRSWLFSNVYNDLVRKYVSEKDTIHSLTSRTDLWLYQTDTVLGFPRPSMPNMVQVGGLMAGRPVGPLSEDMGDFMQSSGDDGVIVVSFGSMVHTMSTERKEMFAAVFAQLRQKVVWRYAGEKPAGLGNNTRLLSWLPQNDLLAHSKTRVFVNHAGLNGVYEALYHGVPMVCFPLFGDNPGNAARVVARGLGVSLDFRTVTSDQLYQAVHQVLTNNSYRETAARLSHLHRDQPQSPMERAVWWIEHVIKHGGLPHLRARAVELPWYQYYLLDVAAFLLGICSAVLGTLWYSFSFVCRKVCCKRGGKLKSQ

SEQ ID NO: 8366 - protein, 530 aa, Trichechus manatus
  MOD_RES (99)..(99): Any amino acid
  MOD_RES (194)..(194): Any amino acid
  MOD_RES (339)..(339): Any amino acid
  MOD_RES (382)..(382): Any amino acid
MSMKWVSVLLLIQLSCYFSSGTCGKVLVWPTEYSHWINIKTILDELVQRDHEVTVLTSSASILIDPNTLSAIKFEVYPTSLTKDDFEFVFMKWIRKITXHLPKDIFWTYFSLLQEMAWEYSDCIERLCKDVVFNKKLMVKLQESSFDVVFADAIGLCGELLAELLKIPFVYSVRFTSGYTFEKYSGGLLTPPSXVPIVMSELQDQITFLERVKNMIYVLYFDFWFQGFNKKRWDQFYSEVLGRRTTLFETMGKAEIWLIGTYWDFEFPHPFLPHFYFVGGLHCKSANPLPKEIEEFVQSSGTHGVVVFTLGSMLSNITEERANTIASALAQIPQKVVWXFDGKKPDILGPNIRLYKWIPQNDLLGHPKTKAFITHGGTNGIXEAIYHGIPLVGIPLFVDQPDNIAHRKANGAAVSLDMKTMTSTDLLNALKTVINDPFYKESAMRLSAIHHDRPVKPLDKAVFWIEFVMRHKGAKHLCPATLSLTWYQYHSLDVIGFLLACVAVVTFLVIKCCLFGYQKFMKTGKKKKRE

SEQ ID NO: 8367 - protein, 530 aa, Microtus ochrogaster
MSVKMTAALLLLQLSSFFGSGSAGKVLVWPMEYSHWLNLRIILDELVKKGHEVTVLRPSSFLSYEVDNTSAIEFETYPSSYSTADVKGLFMESIRKQIYEMSKKSFWRYFLMLQDVVWLYSDYFESLCKDVVFNKDLMTKLQNSSFDVIVSDPFIPCGDLLAEILKIPLVYSLRFFPGSTYEKYSGGLPLPPSYVPPAMSQLSDRLTFTERVQNLIYVFYFDFWFQTFNEKKWNQFYSKVLGRPTTLSEMMGKADIWLIRTYWDLEFPHPVLPNFDYVGGLHCRPAKPLPKEIEDFVQSSGEHGVVVFSLGSMVGALTEERANVIAAGLAQIPQKVLWRFEGKKPDTLGSNTRLYKWIPQNDLLGHPKTRAFITHGGTNGIHEAIYHGIPVIGIPLFGDQFDNVVHMKTKGAGVRLDILTISSTDLLHAVKTVINDYSYKENALRLSRIHHDQPVKPLDRAVFWIEFVMRHKGAKHLRVAAHDLTWYQYHSLDVLGFLLACVLTVMFVITKCCLLCCQRFTKSGKKKKRE

SEQ ID NO: 8368 - protein, 547 aa, Drosophila willistoni
MELADSCLKDFAMVIRNTFLLTLVVFIVVGSAQGANILGIFTSPSPSHNIVHLSEAKVLADNGHNVTIITCAKLPVNHENFTVVRIPINKEAERQINEGYAAMVQGDSTSFIGMLLHSSKFMRNSLQIMFEVLKDQRVKDLYENKDNKFDLVISGYFVNNYQFGVAHKLKAPLIISFSAQPFGILNTLVGNPLELSYVPAMYTVVKTGETMTFGQRLYTFALTVVQTIWFIVFEWENERRYLELYGDDPSMPKYADLNKNVSLMFIATHGLSEGPIRPNVPAFVEIGGIQVKDKPDPLPKDIEQFLNNATHGAILLSLGSNVKGDHLKPEIVQNMFKVLSNLKQNVIWKWENLEQTPGESSNILYSKWLPQDDILAHPNTKLFITHAGKGGVVESQYHGKPMLALPVFADQPTNAQTMVSHGFGLSLKLLELQADEFHSAIIELLENPKYTTSVQTFSNLFRDRPLSARQTVLYWSEYVIRHHGAKHIQSPLVHMDFISANNLDIFALFLLISLISLWLTKIMLTFAVRKFKSKSSMLAKKIKVKTK

SEQ ID NO: 8369 - protein, 521 aa, Stomoxys calcitrans
MLWMLLCCHSTSTEGHRILAVFSFPGKSHYMMHSALIRELVQRGHQVTMVAAFSLKHLNLGHNYTEILIEPVYDFWSDVIPFLKADNIFDLTTIGVLDYHYMLEVIGLTTTEHALKQPKIQELINHPHPRGEYDLLLCEQFYQEPFLALAHLYDIPVVTSGTLGFENHMSQMMGLLSPWSFIPHGFTDYSDRMTFKERLLNTYYSLGEDILREFHYFPQMDRMVQKYFGHLNVSIPSVSKMEKNISVMLLNSHIPLSAPVPLVPGMVFVGGMHIYPPKKLPQDIQQFLDEAPEGAIYFSLGSNVQSKDMPDDKLRIFLDVFASMKQRVIWKFENESIANLPKNILIKKWLPQSDILAHGNVKVFITHGGLFGTQEGVHHGVPMLGIPFYCDQQLNLKKAERNGYAISLHFQSITHDVLKDALNRLIYDASYHDNVKRYSNIFRDRPIQSRDAAVYWIEYVIRHKGAPQIRSAGLDLTWYQFYLLDVIAFVVAALLLASLAIVILVRQILYGIRQRRKIKMN

SEQ ID NO: 8370 - protein, 485 aa, Odobenus rosmarus
MSMKWISVLLLQLSCYFSSGSCGNVLVWPTEYSHWINIKTILDELIQRGHEVTVLTSSASILVDPSKSSTIKYEIYPVHLQRKDFEDIFRKLIDAWIYNLPRDTFWGYFSQMQDIMWEYSDCLQKFCKDIILNRKLMTKLQESKFDVILADAIGPCGELLAELLKIPFVYSLRFSPGYVFEKYSGGLPLPPSYVPIIMSELSGQMTFMERVKNMIYVLYFDFWFQSFNEKSWDQFYSEVLGRPITLCELMGKAQIWLIRTYWDFEFPRPLLPNFEFVGGLHCKPAKPLPKVLWRFDGKKPDTLGPNTRLYKWIPQNDLLGHPKTKAFVTHGGANGIYEAIHHGIPMVGIPLFADQPDNIANMKAKGAAVSLDFHTLSSTDLLNALRMVINDTSYKENAMKLSRIHHDQPVKPLDRAVFWIEFVMRHKGAKHLRPASHNLTWFQYHSLDVIGFLLACVATALFVTTQCCLFCYQKLAKIGKKEKKE

SEQ ID NO: 8371 - protein, 444 aa, Pongo abelii
MSMKWTSALLLIQLSCYFGSGSCGKVLVWPTEFSHWMNIKTILDELVQRGHEVTVLAYSTSILPDPNNPSALKFEVSPTSLTETEFEDSITQLVKRWSDVPKDTFWPHFLQVQEMMWSYSDMIRKFCEDVVSNKKLMKKLQESRFDVVLADAVSPCGRPTTLFETMAKAEIWLIRNYWDFQFPHPVLPNVELVGGLHCKPAKPLPKEMEEFVQSSGENGVVVFSLGSMVSNTSEERANVIATALAKIPQKVLWRFDGNKPDTLGLNTQLYKWIPQNDLLGHPKTRAFITHGGANGIYEAIYHGIPMVGVPLFADQLDNVAHMKAKGAAVSLDFNTMSSTDLLNALKTVINDPLYKENAMKLSRIHHDQPVKPLDRAVFWIEFVMRHKGAKHLRVAAHDLTWFQYHSLDVIGFLLACVAAVIFIITKCLFCVWKFVRTGKKGKRD

SEQ ID NO: 8372 - protein, 530 aa, Jaculus jaculus
MSVKWASVFVLLHLMGLLRRGACGKVLVWPTEYSHWINIKIILEELVHRGHEVTVLTSSASVLIDPSQPSAIKFEVYSISMTKEEVEAFYMSLISEWMNHFKKNSFWPNYSKLKQRFDEHTDFVRNLCRGVVLNKSLMEKLRASKFDVVLADAVSPCGELLAELLNTSLVYTLRFTPGYTYEKYSAGLPFPPSYVPVVLSELSDQMTFMERVKNMIHVLYFDFYFYTSDEKKWNQFYSEVLGRPRTIVELMSTADIWLIRMYWDLEFPRPLLPNVDFIGGLHCKPAKPLPKEMEDFVQSSGEHGIVVFSLGSMVYNLTEEKANMIASALAQIPQKVVWRFDGKKPDTLGSNTRLYKWIPQNDLLGHPKTKAFLAHGGTNGLYEAIYHGIPVVGIPLFADQPDNIAHMTSKGAAVRVDFSTLSSADLLSALRTVLNDPSYKENAMRLSRIHHDQPVKPLDRAVFWIEFVMRHKGAKHLRPALHDLSWFQYHSLDVLGFLLACVLSVVFVITKCCLLCCGKFGKAGKKEKRA

SEQ ID NO: 8373 - protein, 530 aa, Carlito syrichta
MVSEKWASVVILLQFCFAGCGYSGKILVWPCDMSHWLNLKTILDKLIERGHEVTVLTYSQTFLIDYKKPSALKFVVVNVTQDKDYAKKSNNEFVNFVLHVLPNSSTWQSVIKLNDFFVKLSGFFKFLCESFVYNQTLMKKLQEANYDVMLIDPVIPCGELLAELLAVPFVVSLRASIGGNMERHCGKLPAPPSYVPVLMSRLTDNMTFLERVKNIMLSFFFDFWIQDYNFHFWKDFYSKILGRPTTLCETVGKAEMWLIRTYWDFEFPQPYLPNFEFVGGLHCKPAKTLPKEMEEFVQSSGEDGIVVFSLGSMLQNLTTEKADLFASALAQIPQKVLWRYQGKKPATLGANIQLYDWIPQNDLLGHPKTKAFITHGGINGIYEAIYHGVPMVGVPIFGDQYDNIIHMKAKGAAVEINFSTMTSADVLRALRTVIYEPFYKENAMRLSRIHHDQPVKPLDRAVFWIEYVMRHKGAKHLRPAVHDLTWFQYYSLDVIGFLLACIATALFLIIKCCLYSCQKFGKTGKKKKKE

SEQ ID NO: 8374 - protein, 530 aa, Rattus norvegicus
MPGKWISALLLLQISCCFQSGNCGKVLVWPMEFSHWMNIKTILDELVQRGHEVSVLKPSAYYVLDPKKSPDLKFETFPTSVSKDELENYFIKLVDVWTYELQRDTCLSYSPLLQNMIDEFSDYYLSLCKDTVSNKQLMAKLQESKFDVLLSDPVAACGELIAEVLHIPFLYSLRFSPGYKIEKSSGRFILPPSYVPVILSGMGGPMTFIDRVKNMICTLYFDFWFHMFNAKKWDPFYSEIFGRPTTLAETMGKAEMWLIRSYWDLEFPHPTLPNVDYIGGLQCRPPKPLPKDMEDFVQSSGEHGVVVFSLGSMVSSMTEEKANAIAWALAQIPQKVLWKFDGKTPATLGPNTRVYKWLPQNDLLGHPKTKAFVTHGGANGVYEAIYHGIPMVGIPMFGEQHDNIAHMVAKGAAVTLNIRTMSKTDLFNALKEIINNPFYKKNAVWLSTIHHDQPMKPLDKAVFWIEFVMRHKGAKHLRPLGHDLPWYQYHSLDVIGFLLSCSAVIAVLTVKCFLFIYRLFVKKEKKMKNE

SEQ ID NO: 8375 - protein, 530 aa, Fukomys damarensis
MSMKWISALLLLQLDCYFSFGSCGKVLVWPMEYSHWMNMKNIVEELIQRAHEVTVLRPSSFIFVDVNSSSGIKFETFITSTNDDQLEDIYIESVNKWMSVGSIDTCLAYFPVLEDTIRDYSAIWENICKDVASNKKLMTKLQESRFDVLLADPIAPCGELVAELLKIPFVYSLRFSPGFQMEKHGGGLIVPPSYVPLTLSRLSGQMNFIERVKNMICLLYFDLWFGTFNEKNWNELYSEILGRPTTLHEIMGKAEMWLIRSYWDLEFPRPSLPNFDFVGGLHCKPAKPLPKEVEDFVQSSGEHGVVVFSLGSMISSMTEERANAIASALAQIPQKVLWRFEGKKPDTLGSNTRLYKWLPQNDLLGHPKTRAFVTHGGANGVYEAIYHGIPMVGIPLFAEQHDNVAHMKAKGVAVKVEFMTISSTELLNALKKVLNSPSYKENAMWLSTIHHDQPMKPLDRAAFWIEFVMRHKGAKHLRPLAHNLTWYQYHSLDVIGFLLAGVVTITLLVVKCCFFISRKFLKMKKKKKRE

SEQ ID NO: 8376 - protein, 529 aa, Ochotona princeps
MSARWISVLLLLQLSCHFSAVGCGKVLVWPMDFSHWINMKTILDELVQRGHEVTVLKSSVSVLLDHNESSAIKYETFPVSTPKDVYEKAFSNDLMKHVYELHKYSFWNFLSKLQQIQYEISDFFQIICRDAVLNKELVTKLKESRFDVIFADTLCPCGELLAELLKVPFLYTHRLFPGYTYEKYSGGFLLPPSYVPITMSELTDKMTFMQRVKNMLYVLYFDFWFQFFNEKKWDQFYSEVLGRPTKLTELMGKAEMWLIRTYWDLEFPRPLLPNVDFVGGLHCRPAKPLPKELEDFIQSSGEEGIVLFSLGSMVSNLTEETANVIATALAQLPQKVLWRYSGKKPRTLGPNTQLHTWVPQNDLLGHPKTRAFITHGGTNGIYEAIHHGVPLVGIPLFADQFDNIAHVKAKGAAVKVDFITMSSADLLSAVKTVINDPSYKENAMTLSRIHHDHPMKPLDRAAFWIEHVMRHKGAKHLRVSAYDLTWYQYHSLDVIGFLLACVTTAALIIIKCCLFCYRMFVKSVKRKRE

SEQ ID NO: 8377 - protein, 513 aa, Anopheles darlingi
MKCALCIAALVVLLACVAPLEAYRILCVYPSSGRSHVLIGQALLKGLAERGHEVTMVSPFKLSKPVSNYREIVVPKVDLSDMTKDFLQKNSGQSVSMMLNLFQSQIDTAEMLLQDPQFLAIKNEHFDLVIVGYFVADYVLGLGPHFNAPTVILYSAGMTKMTADYIGNPRAVSTVPSMLLGGKEPMGFVKRVINFLVSGFEDVISAVLVYAQTEYYQRYFPSDRYPAYTDVRKNVSLVLLNTHFSQAVPRPYLPNMIEVGGLQIKSKPDPLPADIQEWLDGAEHGAVYFCLGSNLKSADLPPAKLDAILKTFAKLKQRVLWKWESDTIPNAPPNVLSKAWLPQDDVLAHRNVKLFISHGGLGGVAEAKYHGVPVLGIPIFAEQHQNVQTMVEEGIAMLLEYQELDEQSFSRAVNIMLREHRYTERVKEISTRYRDRPQSSMNLACYWIEYVARHRGAPHLHYPGADMNFLQRESLDVIAALLLAGYLVFKVLKLLIKFIFRKLFKSTRKTKQN

SEQ ID NO: 8378 - protein, 325 aa, Rattus norvegicus
MTGVTPGVFAVLSEGILSSCTVNFPLPSGLPESTLHGRPTTLSETMAKADIWLIRTYWDLEFPHPVLPNFDFVGGLHCRPAKPLPKEIEDFVQSSGEHGVVVFSLGSMVGSLTEERANVIAAGLAQIPQKVLWRFEGKKPETLGSNTRLYKWIPQNDLLGHPKTRAFITHGGTNGIYEAIYHGIPVVGIPLFGDQKDNIVHLKTKGAAVRLDFLTMSSTDLLTALRTVTNDPSYKENAMRLSRIHHDQPVKPLDRAVFWIEFVMRHKGAKHLRVAGHDLSWVQYHSLDVIGFLLACVVTVMFILKKCCLFCCQKFTKAGRKKKKE

SEQ ID NO: 8379 - protein, 446 aa, Ochotona princeps
MSRKCISVLLLLLQLSCCFRSGSGGKVLVWPMEYSHWMNLNVILDELVRRGHEVIVLRNSASIFLDPSKHTGIKFETFPVSFTKNDLENFFTQWVTNWTETDKDSYWKYLLALQDIFGVYSGLYEILCKEAVLNKQLMAKLQEAKFDVILSDAIGPCGRPVKFYDLVGKADMWLIRSYWDLEFPRPTLPNVHFVGGLHCKPAKPLPKDMEDFVQSSGEEGVVVFSLGSMVGNGTEERANVIASALARLPQKVLWRFDGKDPKSLGPNTRIFKWIPQNDLLGHPKTRAFVTHGGANGIYEAIHHGIPMVGIPLFGEQPDNIAHMTAKGAAVRLNWKTMSSADLLNALRTVINDPSYKENIMTLSRIHHDQPMKPLDRAVFWIEHVMRHKGAKHLRVAAHDLTWYQYHSLDVIGFLLACVTIISFLIIKTCLFICQKFADIGRKKKRD

SEQ ID NO: 8380 - protein, 529 aa, Condylura cristata
MSVKWMSALLLLQLGCYFSSGSCGKVLVWPTEYSHWMNIKTILDELVARGHQVVVLTSSASILIDPSKPSAIKFEVYPTSFSKAEFESAFKQVVSEWTYELPKDSFWSYFSKSQDILWRFFDIVNQLCKDVVKNKKLMTKLQESRFDLILSDPVGPCGELLAEVLKVPFVYTLRFIPGYQFEKHIGKLPIPPSYAPFVLSELSDKMTFTERVKNMIYMLYFDFWFQTINYKQWNEFYSEVLGRPTTLAETMGKAEMWLIRTYWDFEFPRPFLPNFEFVGGLHCKPAKPLPKEMEEFAQSSGENGIVVFTLGSMVSNMPEERANVIASALAQIPQKVLWRFDGKKPATLGANTRIYKWIPQNDLLGHPKTKAFITHGGTNGIYEAIYHGVPMVGVPLFADQPDNMVHMMAKGAAVRVDFHTMSSTDLLNALKTVINDPSYKENIMKLSRIQRDQPMKPLDRAIFWIEFVMRNKGAKHLRPASHDLTWAQLHSLDVIGFLLACVVTAVYVIIRCFLFCCRKVVKSGKDKRE

SEQ ID NO: 8381 - protein, 530 aa, Aotus nancymaae
MALKWISVLLLIQFSCYFSSGSCGKVLVWPMEYSHWINMKTILDKLVSRGHEVTVLASSASILVDSSKSSAIKFEVYPTSLTKNDFENVFIKQITRWIYNCPKYTFWEYFSQVQEMLWNYGKCIKTFCEDVVSNKRLMTKLQESKFDVVLADAIAPCGELLAELLKVPFVYSLRFSPGYILEKHSGRLLFPPSYVPVAMSELSDQMTFVERVKNMIYMLYFDFWFQIFDLKNWDQFYSDVLGRPTTLFETMGKAEMWLFRNYWDFEFPRPILPNVDFVGGLHCKPAKPLPKEMEDFVQSSGENGIVVFSLGSMVSNITEERANVIASALAQIPQKVLWRFAGKKPNTLGSNTRLYKWLPQNDLLGHPKTKAFITHGGANGIYEAIYHGIPMVGIPLFAEQPDNIAHMKAKGAAVGVDFNTMSSTDLLNALKTVINDPFYKQNTMKLSRIHHDQPMKPLDRAVFWIEFVMRHKGAKHLRVAAHDLTWFQYHSLDVIGFLLTCVAAVIFIITKCCLFCFRKFVKTGNKEKKS

SEQ ID NO: 8382 - protein, 528 aa, Merops nubicus
MMGPRFSWFWVYACCWSAGFCGKVVVWPTDASHWINVKVLLEELVLRGHEVTVLVPSSNLLIDYEDTSSPFTFEVLQAPFTQKTLDALMEDFVNFWTNEVSNVYPWEIIWRMKEDLEVFTDLTKKICDTLLTNPQLIAKLQKAKFDVLIADPFSVGGELIAEILAIPFVYSFRFSDGNAVERLCGGLPSPPSYVPASTRGLTDHMSFVERLQNFLFYFYTDVFFLKFWREEWDGYYSNVLGRPTTLCETMGKAEIWLIRTYWDLEFPRPFLPNFEFVGGLHCQPAKPLPKEMEEFVQSSGKHGIVVFSLGSMVYNLSDEKSNMIARALRQLPQKVLWRYKGKKPETLGSNTRIYDWIPQNDLLGHPLTKAFITHGGTNGIYEAIYHGIPMVGIPMFGDQHDNIAHMKAKGAAVGLDFSTLKTQELVDALNTVINNSTYKENALRLSKIHHDQPLKPLDRAVFWIEFVMRHKGAKHLRPASHHLTWYQYHCLDVLALLFTCTAITVFISAKCCLFCCRRCGRIVKRKKE

SEQ ID NO: 8383 - protein, 218 aa, Cricetulus griseus
MVKNLTDEKANIVASALAQIPQKVVWRFEGKKPDTLGSNTRLYKWIPQNDLLGHPKTKAFIAHGGTNGVYEAIYHGIPIVGIPLFADQADNIHHLVAKGAAVRVDFNTLSTTNLLTALRTVINDPLYKENAMKLSRIHHDQPVKPLDRAIFWIEYVMRNKGAKHLRPALHDLAWFQYHSLDVIGFLLVCVAAVVFIITKCCLLCCHKTANMGKKKKKE

SEQ ID NO: 8384 - protein, 527 aa, Dinoponera quadriceps
MKVLSVLLAILVTCDQSANGFRILGVFPLHGHSHWVMNEPLMKGLAQRGHQVDVITHFPQKKPVPNYTDISLFGSLPNVRNNISATEIQAFGGLSMKHLTEIAGNNICELLAHPKIQDLIKNPPQDPPYDLVIVEVFMAPCFLAFGRHLKVPLVATVTCSFHDWLNELSGNSFNPSYVPSLFSSFGQHMNFKERMLNFLTSHLISAQILYHTEFQAEYLKKYFDMQDTAIMDLYSDISLYLVNSHYSLSGIRPLTPAIVEVGGLHVKSDNVSLAPEVQKWLDESKDGCVYFTFGSMVRIETFSKELMEEFYASFKKIAPVRVLMKVAKKEDLLPGLPDNVMTQSWFPQIAVLKHKNIRAFITHGGLMGTQEAIYYGVPMIGIPLFGDQKINIQSYERKKIAISLNSVQDVTEEKLTSALNSILKDPTYRENVQYFSKLFVDRPLSPLDTAIFWVEYIKKYGNFLQSPAMQLYWWQRHLLDVYAFLLLIVIVVLLVVMFILRKLKRLLFGSHVCTKKDSAAIKAKKNK

SEQ ID NO: 8385 - protein, 503 aa, Anopheles sinensis
MLLILIALVGVSHAANILFMSGVPSPSHYIWQRPLMWEMGKRGHNVTVLSADIEKQPPTNVTYIHLENFYSTMYNTSMREKVDFFDMASQSPIKLLGLFDEFGMNLCEAAIESEGLNFLLNYPKDFKFDLFLSDIMIGPCLPSIIMHRFKDVSYIPVTPYNAPSTAASVLGSYAYSGLVPNHVYDVPEVMSFVQRVKNFYYDAYEMILHEVYMHPEADRILRTIYPSAPSTTTFYKNVRVSFINANPIIQYKEPMMPNMIPVGGLQIQPPKPLPEDLRKVVDAAQNGFILFSLGSNARSDLLGPERIRNILSAMERLPQYQFLWKFESDESKLPVPIPKNVYIRAWMPQNDLLAHPNIKLFITHSGLLSTQEAIWHGVPVIGFPLFADQFRNINYCVEAGIAKRLTIQHFKANELVDAVKEILGEPKYATKMKQVSRLFRDQPETPLERAVWWCEWVLRNPDADLLQSRAVHLSWFRKYSYDVLSFVLGVAVLLLATSKSKIE

SEQ ID NO: 8386 - protein, 218 aa, Rattus norvegicus
MVGNLTEERANVIAAGLAQIPQKVLWRFEGKKPETLGSNTRLYKWIPQNDLLGHPKTRAFITHGGTNGIYEAIYHGIPVVGIPLFGDQYDNIVHLKTKGAAVRLDFLTMSSTDLFTALKTITNDPSYKENAMRLSRIHHDQPVKPLDRAVFWIEFVMRHKGAKHLRVAAHDLSWVQYHSLDVIGFLLACVVTVMFILKKCCLFCCQKFTKAGRKKKRE

SEQ ID NO: 8387 - protein, 279 aa, Chinchilla lanigera
MAKAEMWLIRSYWDLEFPRPTLPNTEFVGGLHCKPAKPLPKEMEEFVQSSGEHGIVVFSLGSMVHNLTEERANVIALALAQLPQKVIWRYSGKKPDTLQPNTQLYEWIPQNDLLGHPKTKAFVTHGGANGIYDAINHGVPMVGIPLFGEQHDNIAHMEAKGAAVVLDFMTMSTADLVNALKEVMNNPSFKENVMWLSTIHHDQPMKPLDRAAFWIEFVMRHKRANHLRPLAQNLTWYQYHSLDVIGFLLACVVTVTLLVTKCCFFCYQKIVKTGKKKKE

SEQ ID NO: 8388 - protein, 244 aa, Mesocricetus auratus
  MOD_RES (178)..(178): Any amino acid
MPSLQEIEDFLQSSGEHGVVVFSLGSMVGNLTEERANVIAAGLAQIPQKVLWRFEGKKPDTLGSNTRLYKWMPQNDLLGHPKIRAFITHGGTNGLYEAIYHGVPVVGIPLFADQFDNVVHMKTKGAGVRLDILTMSSTDLLNAVKTVITDPSYKENVMQLSRIHHDQPVKPLDRAIFXVEYPMRNKGAKHLSVAVHDLTWFQYHSLDVIGCLLACVITVIFIITKCCLFCCQKFAKAGRKKKRE

SEQ ID NO: 8389 - protein, 486 aa, Erinaceus europaeus
MPMKGISVLLLLQVACYFSSGKCGKVLVWPTEYSHWMNIKTILDELAQRGHEVTVLTSSASILIDPNKKSAIKFETYPTSVSKDEFNNVIMEVIHTWIYKMPKDAFWSHFSILQEQLWKFHVVVYKLCREAVLNKNLMMKLQESKFDLVLSDPVSPCAELLGELLNVPFMYTLRFTPGYELERHQGGMPLPPAYVPVVLSELSDHMSFMQRVKNMIYVLYFDFWFQFVNEKLWDPFYSEVLGRPTTLHETMKKAEMWLIRTYWDFEFPRPFLPNFEFIGGLHCKPAKSLPKVLWRFEGKKPDTLGKNTRLYKWLPQNDLLGHPKTKAFITHGGTNGIYEAIYHGVPMVGIPLFADQPDNIAHMKAKGAAVGLNLDTMSSKDLLSALKTVINDPSYKENAMKLSRIQHDQPVKPLDRAVFWIEFVMRHKGAKHLRPAAHDLTWVQYHSLDVIGFLLACVAATVYIITAGCLFCFRKCTKSGKREKRD

SEQ ID NO: 8390 - protein, 524 aa, Branchiostoma floridae
MLTGLHLSLAVAAILSQQVQAADILVATMTYTSAWMDVAKIAEVLASRGHIVTVLAHASQKSDLMRKLPTLRYETFGDPEKPPSVKEFSTTIPQKMAFSSPGVLAQIALGSTLASAMLDFSNEMLSDKQLLTKLKNSHYDVVLTYPMTSCGPLVAQYLDLPLVCTMRSLPSGQDVRATGVPYPLAYVPTVGSGLSDRMTFLQRVKNVLVYFAFSTAGQLVFDKGYDDLAKRTIGDNFTMSAALARTDVWLYQSDVMFDFPKPMMPNMVSIAGHVADDVKPLSEELEKFVQSSGDDGVVLVTFGSMVAAMPAEKADMLAAAFARLPQKVVWRYAGTPPPSLGSNTKTMEWVPQNDLLAHPKTKAFVSHCGYNGVAEAMYHGVPLVGMPLFAEQFDNIARMVARGMAVSLDIHTVTSEEVSQAITSVISDPSYKEKTNLISTHLRDQPQSPMERAVWWIEHVIKHGGLPHLRSRAPELPFYQYYLLEVIALIVAVISAVLLSCWKCCSFACRMCKRSMTTTKLKIN

SEQ ID NO: 8391 - protein, 445 aa, Bos taurus
MSMKRLSLLLLLQLTCYFSGGSCGKVLVWPVEFSHWLNIKTILEELVTRGHEVTVLISSASTIPNSSKPSTMKFETFPVSLTKSDYENFMERILEELTYVAKDSFWSYLSTVKNVFWEFFDIALRMCEDAVSNKKLMTKLQESRFDILIADAVGPCGRPTTLSETMGKADMWLIRSYWDFSFPRPRLPNVEFVGGLHCKPAKPLPKEMEEFVQSSGENGIVVFSLGSMVSNMSEDRAKVIASAFAQIPQKVLWRYDGKKPDTLRPNTRLYKWLPQNDLLGHPKTKAFITHGGSNGVYEAIYHGIPMVGTPLFADQADNIARMKSKGTAVRLDLETMSTRDLLNALKEVINNPSYKENVMRLSAIQHDQPMKPLDRAVFWIEFVMRHKGAKHLRPAIHDLTWFQYHSLDVIGFLLACVATAIFVITKCCLFCCLKFAKLGKKEKRD

SEQ ID NO: 8392 - protein, 533 aa, Parus major
MAMKTTGSKKYLQLLLFQVALLGPVFCGKILVWPTEGSHWMNMNVIIQELIRRGHSFTILVSNATLYIEPRPKATEKFETYYVPFKKDVPENLINGIVDLWLNNRPTVLTFWQFYKELGRLSVGWQEMNKMMCDAVLTNQELMARLQGSGFDLMLSDPVTPCGELVAVKLGIPFVYSLRFSPAFTLERHCGKIPTPPSYTPAALSELTDHMSFGERVKNFVSYHLQDYVFQSYWGHWDIYYSKALGRPTTLCETMGKAEIWLIRTYWDFEFPRPYLPNFEFVGGLHCQPAKPLPKEMEEFVQSSGEHGVIVFTLGSMVHNLSDERSNVIAKALSQLPQKVLWRYKGKKPETLGSNTRIYGWIPQNDLLGHPLTKAFITHGGTNGLYEAIYHGIPMVGIPMFADQHDNIAHMVAKGAAVQVDFNTMKTQDLVDALNTVIYNSTYKENALKLSKIQHDQPVKPLDRAVFWIEFVMRHKGAKHLRPAAHHLTWYQYHSLDVLAFLFTCTATIVLILFKCCLCCCRRCGRIAKRKKE

SEQ ID NO: 8393 - protein, 204 aa, Fukomys damarensis
MSLAWDLKQVLWRFEGKKPDTLGSNTRLYKWLPQNDLLGHPKTRAFVTHGGANGVYEAIYHGIPMVGIPLFGEQHDNIAYMTDKGAAVNVNFLTISSTELLNALKMVLNSPSYKENAMWLSTIHHDQPMKPLDRAAFWIEFVMRHKGAKHLRPLAQNLTWYQYHSLDVIGFLLAGVVTITLLVIKCCFIISQKFLKMKRKKKRE

SEQ ID NO: 8394 - protein, 238 aa, Colobus angolensis
MEEFVQSSGENGIVVFSLGSMISNMSEESANMIASALAQIPQKVLWKFDGKKPNTLGSNTRLYKWLPQNDLLGHPKTKAFITHGGTNGIYEAIYHGIPMVGIPLFADQHDNIVHMKVKGAALSVDIRTMSSRDLLNALKSVINEPIYKENAMKLSRIHHDQPMKPLDRAVFWIEFVMRHKGAKHLRVAAHDLTWIQYHSLDVIGFLLACVATVIFIITKCCLFCFRKLAKTGKKKKWD

SEQ ID NO: 8395 - protein, 280 aa, Microcebus murinus
MKKADMWLIRTYWDFEFPRPLLPNFDFVGGLHCKPAKPLPKEMEDFVQSSGENGVVVFSLGSMLSNMTEERANVIASALAQIPQKVLWRYDGKKPDILGPNTRLYKWLPQNDLLGHPKTKAFITHGGANGVYEAIYHGVPMVGIPLFADQPDNVAHMKAKGAAVRVDFNTMSSTDLLSALRTVINDPMYKENAMKLSRIHHDQPVKPLDRAVFWIEFVMRHKGAKHLRVAAHDLPWFQYHSLDVLGFLLACVATAIFVIMKCSMCFWWMIATAGKKAKRE

SEQ ID NO: 8396 - protein, 488 aa, Sus scrofa
MNKMLMKQFSLLLLLQLTCYFSSGRCGNVLAWPVEYSHWINMKAILEELVTRGHEVTVLISSASIFIDPSKPSAIKFEIYPASVTKEEYENFFMHFFGEWTYLEKNSFWTYFPAMIRIIRKYFEISLKFCKDLVSNKKLMTKLQESRFDVILADAVGPGGELLAEILNIPLVHSLRFYPGYAMEKHGGKLPFPLSYVPIIMSELSDHMTFMERVKNMIHALYFDFWFQTFNEKKWNQFYSEALGRPTTLFETMGKADMWLIRNYWDFDFPRPLLPNFEFIGGFHCKPAKPLPKVLWRYNGKKPDTLGPNTRLYKWIPQNDLLGHPKTKAFITHGGTNGIYEAIYHGVPMVGIPLFADQPDNIAHMTAKGAAVRLDLKTMSRTDLVNAVKQVINNPFYKENVMWLSTIQHDQPVKPLDRAVFWIEFVMRHKGAKHLRPAAHDLTWYQYHSLDVIGFLLACVATAAFALTRGCLFCCRKLANAGKKAKRE

SEQ ID NO: 8397 - protein, 532 aa, Heterocephalus glaber
  MOD_RES (146)..(146): Any amino acid
  MOD_RES (347)..(347): Any amino acid
MMSMKWISALPLLQMSCYFNSGSCGKVLVWPMDYSHWMNIKNILEELIQRRHEVIVLRPSSFIFIDANSSSGIKFETLTTSINRDEWGKYFAQFITTWMNIGSIDSCIAYFPEGENIFKEFSDTWHNLCKEIVSKKIIMKKLQESXVFDVLLADAIGPCGELVAELLKIPFVYTLRFSPGFQLEKFGGGLMLPPSYVPVVMSRLSGQMTFMERVKNMICMLYFDFWLETFNEKKWNLLYSEVLGKPTTLYETVAKAEMWLIRSYWDLEFPHPTLPNFDFVGGLHCKPAKPLTKEMEDFLQSSGEHGVVVFSLGSMVSNMTKERANVIASALAQIPQKVLWRFDGKKXNTLGHNTQLYKWLPQNDLLGHPKTRAFVTHGGANGVYEAIYHGIPMVGIPLFGEQHDNIAHMVAKGVAVKVEFITLSSTELLNALVRVLNNPFYKENAMWLSTIHHDQPMNPLDRAVFWIEFVMLHKGAKHLRPLTQNLTWYQYHSLDVIGSLLACVATITFFVIKCCLFCSQKFVNVRKKQKRE

SEQ ID NO: 8398 - protein, 487 aa, Bos mutus
MNMMAMKRLLLLLLLQLTCYFSSGSCGKVLVWPVEYSHWMNMKIILDELVMRGHEVTVLTSSASILIDPNKPSAIKFENFSVSLTKDDFEDALKNFVGNWTDLTNSFWTFPLLLQSLFDEYSDLTLKICKELISNKKFMTKLHESRFDVVLADTVGPCGELLAEIFKVPLVYSVRFTPGYSIERKSGKLPYSPSYVPVILSELSDHMTFMERVKNMIYVLYFDFYFQMLNEKKWDQFYSEVLGRPTTLLETMGKAEFWLFRSYWDFEYPCPLLPNVEFIGGLHCKPAKPLPKVLWRYDGKKPDTLGPNTRLYKWVPQNDLLGHPKTKAFITHGGTNGIYEAIYHGVPMVGLPLFAEQPDNINRVKAKGAAVRLNLETMSKTDFLNALKQVINNPSYKRNAMWLSTIQRDQPMKPLDRAVFWIEFVMRHKGAKYLRPAAHKLTWFQYHSLDVIGFLLACVATAVFVITKCFLFCCRKFAETGKKRKRE

SEQ ID NO: 8399 - protein, 348 aa, Camelus ferus
MYEELPYHETGFTQSEHGVYSTLFYCHKRLENWLLYTLIDMLYSYYIFPEWDAYYSNVLGKPTTLCETMGKAEMWLIRTYWDFEFPQPYLPNVEFVGGLHCKPAKPLPKDLEEFVQSSGEDGVVVFTLGSMIRNLTEEKANMIASALAQIPQKVLWRYTGKKPDTLGANTRLYEWIPQNDLLGHPQTRAFITHSGTNGVYEAIYHGVPMVGIPMFGDQHDNVARVKAKGAAVEVDLPTMTSSDLLHALKEVINNPSYKENAMKLSRIHHDQPVKPLDRAVFWIEFVMRHKGAKHLRPALHDLTWYQNHSLDVIGFLLACVATAVFVITKCCLFCCLKFGKTTKKKKRE

SEQ ID NO: 8400 - protein, 525 aa, Cynoglossus semilaevis
MEQQQHLFVCILLAFCLTSSTNGGKVLVWYTEASHWINMKHVLETLVDRGHAVTVLMLFMDNKDSKFKYETFNVSFPLEEIEKFLEDYLHFSMYEMDQLSYLQIYIRHIELAKMDLYYNLKYLDGIIKSEFMMKKLKDENFDVLLADPIYPGSDLVADILGIPLVFTLRFSLVNNWERHCGQRPAPPSYVPGAMSKLTEKMDFSERVWNFGFYLLNDLMYQHFFWKDIDKYYSDVKGTPTSGCEMMGKADFWLIRTYWDFDSPHPILPNFKYVGGIHCKPAKPLPKHIEEFVQGSGEHGVIVFTFGSMINNITREKANMIASALAQIPQKVLWKYKGETPETLGANTRLYDWIPQNDLLGHPKTRAFVTHGGTNGIYEAIYHGVPMVGIPMFADQPSNIIQLKARGAALILNLNFMTTEDFRDALTIVINDKSYKENAMQLSRIHHDRPMSPRDEAIFWIEYTMRNKGAKHLRVQAHELTWFQYHSLDVLVFLLSIVLLITLLFIKACSLCFRRCCGSKRKTKRE

SEQ ID NO: 8401 - protein, 411 aa, Loxodonta africana
MSMKWISVLLLIQLSCCFSCGTCGKVLVWPPEYSHWMNMKTIVDELIQRGHEVTVLTPSASVLIDPNKPSAIKFEVYPTSLTEDEFEYVFMKLVRRWTNEVPKDTFWTCFSKKWDQFYSEVLGRPTTFSETRGKAEIWLVRNYWDFQFPRPFLPHFHFVGGLHCKPANPLPKEIEEFVQSSGKHGVVVFTLGSMVSNLTEERANMIASALAQIPQKVLWRFDGKRPDTLGPNTWLYKWIPQNDLLGHPKTKAFITHGGANGIYEAIYHGIPMVGIPLFADQPDNIAHMKVMGAAVRLNMDTMTSTDLFNALKTVIYDPSYKENAMRLSAIHRDQPVKPLDRAAFWIEFVMRHKGAKHLRPAALSLTWYQYHSLDVIGFLLACVAIVSFLVIKCCLLGYQKFYKTRKKKKRE

SEQ ID NO: 8402 - protein, 1331 aa, Chelonia mydas
MAPSSAPMGAAGAVPVDGAVCKATWLHLRLGAREWTCHCFWEPLETDQDPNAASLLDVFNYWLKSPDAKKRKAVPNGPPAKKSKKESSSSSDESSSEEDEKTTAKKPATKSAPVPKVIAKAAAPAKKAESSSEDSSDDSDSEEEEKKPAQKVTKAQAKPAATKTQPQKKAKSSSSSDTSSSEDERPKKQLLKPVAAKTAAKSAGSKAACNAANGKAESSSSSSSEDSDKEKAASAKAVPKKTPLPKPAAIQVPSGKGRAPAKESSSSEDSSDSSEDEKPASKSKPKPGPYSAVPPPQVTEPRKGKAKPSVAKAPGKKAESSDSSDSSSDSSDEMEQTPKKGTTAKASLAKKKPTPTPTAVTIKKGGSSSDSDSDSSSEEEKVVTKLTAKSLAAKGPAKPAKVPAKSGQAKKGSSSSSDSSDSDSSEDETPAKPAVKPAPPAAKKPPAVAKKAQSSSDSDSSSSSSEEEKKAPPAKPASKTAKPASKPCTLVPKASSSDSDSSSSEEEQSKPAVKPASKSPGGSKACAGKKAAAASSSSSSSDSSSDDDKKSRTAGTPVAGLKPGKGGQNNSSLVKEKPKASSTPAAKSPATKKSEPKPAGGSESSSESSCDEKGKANGAVPFRRVREEEIEVDSRVANNSFDAKKGAAGDWGEKAHNVLKFTKGKSFRHEKTKKKRGSYCGGAISTQVNSIKFEIQKWMDGGLDTSLPMVRALGPKFPVNCMHNIVSTFCLVTFALVVCYSITTDVFFSLVATLQWQNYAYCFSFCKLVITTLVTFLRATGEAATRLLRHSNCAKAQSPSTEMRLPPHPVAVLLMVATFSLDCCHGAKVLVMPTIVFDSHLRVFMRVAEALNDRGHNATLLLHEGRESEPFLPGLRVQTYRGIFSMESADAWVQEKIKRVFQGKKTSLEIFSFLEKYLENCDLVLGDAALLQQLRGEGFDLFLVDPNEMCGFILAHLLGIKYAVISTGFWYPAEIGATSPVAYVPEFNSLMTDRMGLVGRTWNLLVYMITRIATKLVILPKFDRLMQKHGVEPQKSMLELVYGTSLFFLCNDVVLDFPRPTLPHVIFTGGILAEPEKPLPVGLRLWVEAADAGVVVVSFGIGIRALPSNLVEKMAGAFARLPQRVVWRYFGQKPNNLGENTLMMEWLPQNDLLGHPNVKAFVSHCGMNGIFEAIYHGVPVVGFPFYGDQFDIMTRVQAKGMGILMDWSRVSEEDLYQAIVTVLSKPSYNKAAKQISALHRDTPMHALNRTVYWLEYILRHDGAPYLRPAVYDLSFYEYFCLDILALFLLCLAGAAYALSKAIVWYRGKRASPVHLNGNCLNGHLVEGKKAQ

SEQ ID NO: 8403 - protein, 529 aa, Cyphomyrmex costatus
MKVLLSVVFVILAFDQIASSYRILGIFPLNGKSHWNMQEALMKELARRGHQVDVVSHFPMKKPILNYNDISLKGSMPQVTNNMTATQLQIFASSTPSMSAFVQMTGNSICALLNHPKIQELIKNPPQDPPYDIVILELFTAPCYMAFGRYLKVPMVGTVASVFHDWLSEVSANPLNPAYIPNMFSAYSQHMNFKERLSNFLLTHYLSWQFHYYTNSQLKLVNEHFGMNLPHIKDLYNDISLYLVNSHHSLNGIRPMTTNVIEVGGMHLSNDDDPMSPELQKWLDESKDGCIYFSFGSMVRIETFSKELLQQIYASFEKIAPVRVLMKVAIKDDLLPGLPKNVMTQSWFPQIAVLKHKNTRAFITHGGLHSTQETIYCGVPMIGIPLFGDQRVNIQNYVNKKVAISLNSITDVTEEKLTSAIKNILKDSTYRENVQKLSKLFLDRPMSAMDTSIFWVEYVAKYGNVLQSPAIKLNCWQRNLIDIYVFIFVVIIIVLYVALFILRKLKKLLFGSHACAKKDNATMKLKKNK

SEQ ID NO: 8404 - protein, 403 aa, Bactrocera dorsalis
MAGLTTGHLLLLLGLCCTLVQASYPLKILGLFPHPGISHFHFFHPLMRGLAEKGHDVTVLSHFPDKSPPARYRDLPLTRHETLTNSVDLKFFETQHFYQHFVEFYMLHEWGKDACNLTLRSDALAQVLRQRQHFDVIIMEQFNSDCMTAVAHQLKAPFIGLSSCAMMAWHYDRVGMPMVPSVMPTLFMGQSEDMTFGARLANWFTDHTMRFLYDFYTTPTTDAMVRHKFGHDMPSVGELAKETSMLFVNQHFSLSGVKPLPPSVIDLGGIHIQKAKPLDPELQKFLDNAEHGVVFISWGSMIRADTVPPAKREAIVRAVKRLKQRVIWKWENSTLANKPDNLYVSKWLPQRDILCHPNVKVFLSHGGLMGSSEAAYCGVPVVGTPMYGDQFMNAAALKYRGMG

SEQ ID NO: 8405 - protein, 492 aa, Sorex araneus
MVFIMDHMMPKKFVQLLVLNLILTEIVLSGNVLIWPTDGSHWLNIKIILEELVKKNHNVTVLAASTTLFIKSNPDSSVNFQEVPVSFNNNNIDDLIEHMIALWLDHRPTPLTLWRFYKELGNLLDTFFRINIQICDGVLHNLELMTKLQRGGFDVLIADPVTICGDLVALKLGIPFIYTLRFSPASTVERHCGKIPAPVSYVPAALSELTDQMTFGERVKNTISYHLQDYIFQSYWGEWNSYYSKILGRPTTLCETMGKAEIWLMRTYWDFEFPRPYLPNFEFVGGLHCKPAKPLPKVLWRYKGKIPDTLGANTRLFDWLPQNDLLGHPKTKAFITHGGTNGIYEAIYHGVPMVGVPMFADQPDNIAHMKAKGAAVEVNINTMTSADLLNALRTVINEPSYKENAMRLSRIHHDQPVKPLDRAVFWIEFVMRHKGAKHLRPAAHDLTWVQYHSLDVIGFLLACVAAALFLVTKCCLFTCKKFGKTGKKKKRD

SEQ ID NO: 8406 - protein, 524 aa, Drosophila grimshawi
MFSLRLSSALVLIFMLPHLLEGARILAIFPFAGPSQYINVLPYLKGLAARGHEITSVNAFPQKEPVKNFRDIPVPEVIESYEELITELSNEMNLWKENNFCNAFFIGTTKSVLRNAQVQRELLQPGKDHYDLIIVEVLRTDALYGFAAHFNAPLIGFSTFGTDWNIDETVGNTSPLSFTPLPTSGFTDHMTFGERVRNFLQTSIAWLNWKLVHLPLQVKLYEQYFPHIAKSKPLMEVSKNFSLMLLNQHFSLSYPRPHVPNMIEVGGLHISHKPAPLPKSIEDFVVGAGSAGVIYFSLGSNIKSNSLPLERRQMLLQVFASLPQRVIWKFEDDQLVNKPANVLIGKWFPQPDILAHPNVKLFITHAGLLSTTESIHHGKPVLGLPFFYDQFQNVERAKRAGFGLSLDHSKMTALELKQTIERLIGEPQFTARAQQISARYHDKPMGPQETAIWWTEYVLRHKGAPHMRVAAQDLSFIAYHSLDVIGLLLAVATLILAAISFVLFKLLRCLRGQSGTSTQKLKNH

SEQ ID NO: 8407 - protein, 546 aa, Austrofundulus limnaeus
  MOD_RES (249)..(249): Any amino acid
  MOD_RES (491)..(491): Any amino acid
MSLPSSLLLLLGLITWSPSSTWGAKVIVVPPIMFESHLYIFKTLATALLQEGHESHFLVSEGREVPPSPHYHLQRYPGIFNSSTADNFLQSKVSNIFSGRLTFLELFDILDHYSQNCDAVVGNVEVMNRLKEAKFDLLLVDPNEMCGFVIAHILNVQYAVFSTGLWYPAEVGAPAPLSYVPEFNSLLTDRMSLMERIANTAVYLVQRFGVHFIVLPKYDRIMKKHGVKPQVAMADLVQGSRLWMLCTDXALEFPRPTLPHVVYIGGILTKPPSPLPQDFELWVRDTTEHGFVVVSFGAGVKYLSQDIAHKLAGALARLPQRVIWRFSGIAPSNLGNNTKLVDWMPQNDLLGHANTRAFLSHGGLNSIYEAMYHGVPVVGVPLFGDHYDTMTRVAAKGMGIMLHWKYMTEDDLFKALTSVIEDTRYRQQAHLLSSIHKDQPGHPVTRAAYWISYILRHNGANHLRSAVYNVSVYQYFLLDVVFTLAAGLALXGFLLSRLVRLLKGKHSRGGATRDDGTLTNGHCHSGSLANGKHKRNGSLKSEKKLN

SEQ ID NO: 8408 - protein, 541 aa, Vicugna pacos
MKSYTPYFMLLWSAVGIAKAAKIIIVPPIMFESHMYIFKTLASALHERGHRTVFLLSEGRDIAPSNHYSLQRYPGIFNSTTSDAFLQSKMRNIFSGRLTAIELFDILDRYTKNCDMMVGNRALIQGLKKEKFDLLLVDPNDMCGFVIAHLLGVKYAVFSTGLWYPAEVGAPAPLAYVPEFNSLLTDHMNLLQRMKNTGVYLISRLGISFLVLPKYERIMQKYNLLPEKSMYDLVHGSSLWMLCTDVALEFPRPTLPNVVYVGGILTKPASPLPEDLQRWVNGANEHGFVLVSFGAGVKYLSDDIANKLAGALGRLPQKVIWRFSGTKPKNLGNNTKLIEWLPQNDLLGHSNIKAFLSHGGLNSIFETMYHGVPVVGIPLFGDHYDTMTRVQAKGMGILLEWKTVTEGELYEALVQVINNPSYRQRARKLSEIHKDQPGHPVNRTVYWIDYILRHNGAHHLRAAVHKISFCQYFLLDVAFVLLLGAALFYFLLSWVTKFIYRKIKSLWSRNKHSTVNGHYHNGILNGKYKRNGHIKHEKKVK

SEQ ID NO: 8409 - protein, 311 aa, Carlito syrichta
MLMARLQKGGFDVLVADPVTICGRPTTLCEIMGKAEIWLIRTYWDFEFPRPYLPNFEFVGGLHCKPAQPLPKEMEEFVQSSGDNGVVVFSLGSMVKNLTEEKANLIALALAQIPQKVIWRYKGKKPVTLGNNTRLYDWIPQNDLLGHPKTKAFITHGGTNGIYEAIYHGVPMVGVPMFADQPDNIVHMKAKGAAVDVNMNTMTSADLLSALRTVIYEPSYKENAIRLSRIHHDQPVKPLDRAVFWIEFVMRHKGAKHLRVAAHDLTWFQYHSLDVIGFLLACVATMIFVITKCCLFSCQKFGKTRKKRKRE

SEQ ID NO: 8410 - protein, 540 aa, Stomoxys calcitrans
MQHNFELKILPFLKCLKLLLLLGYVSNQPTYAAKILGLFPHASESHFMVMRTFMMELARRDHNVTIYSSHRLDDRLDNLKEIIIEPEFPFWKEVQKQAGAKDLLELSKLSDEKLSKYLAQAGAALMDNFLDNYQVKDLLSLQPDDFDYDLIIVDMFYTESLLAMGYYFRTPVVAIVSKDFSDYMELVQEMLVPTACLPYDLENYDANLGFWQRLNNVKQCVNRRNSFIEDHYGSQEKIIKKHFHKIQGGLPSIMDLQSNLALLLVNNYYPLAAPKPLVPNIIPVGGLQIRAPRELPWQIRRFLDEARSGVVYINMGDEQLCGDIPKEKLEALLHVFNKREERFLWTCHDIQKMEGLPKNVMLQHLVPQTDILAHPHVKIFITNGDLLALQESIVRHVPIVGIPMFKNELENVIMAEKLQIGLRIDYANLTETSLSWALDSMAYKEFYILNIRDISKIFRDRPLGGLANALFWLDYVVRYGNQPLRTNGIGMPLGEMHLNDLMIYNFMITLLVLASLVGLYFVGLFVYRKRQTEKMFSKLN

SEQ ID NO: 8411 - protein, 530 aa, Chinchilla lanigera
MSMKRISALLLLQLCCYFSFGSCGKVLVWPMEYSHWMNMKIIVEELIQRGHDVTVLIPSSFIFVDVNASSAIKFETFTASMSRQQLEDFYIRFITKWMNIESVDTCLAYSPVMEDILREYSAVWENVCKEAVSNKKLVTKLQASKFDVLLADPVAPCGELVAELLKLPFVYSLRGSPGFQVEKAAAGLLFPPSYVPVILSRLSGQMTFMERVKNMICMLYFDFWFETFNEKNWSKLYSETLGKPTTLYEKMKQADMWLIRSYWDLEFPRPTLPNVDFVGGLHCKPAKPLPKEMENFVQSSGEHGVVVFSLGSMVSNMTEERANVIASALAQIPQKVLWRFDGKKPDTLGPNTRLFKWLPQNDLLGHPKTRAFITHGGANGVYEAIYHGIPMVGIPLFAEQFDNIAQMEAKGAAVKLEFKSLSTTDLLNALKTVINNPFYKSNAMKLSTIHHDQLMKPLDRAVFWIEFVMRHRGAKHLRPLAQNLTWYQYHSLDVIVFLLALVAIIIFLVLKCCLFCFQKFAKVGKKKKRE

SEQ ID NO: 8412 - protein, 696 aa, Tyto alba
MLNHLLLFQFALLGPVFCGNVLVWPTEGSHWLNVRIVIEELTRRGHSVTILVSNASLFIKPRAEATEKFEVYNVPFKKDTVENLIEEVVALWLNNRPTTLTFWQFYKELGKLSKNWHWMNRLMCDAVLSNRELLAHLQGSSYDLLLSDPVTLCGDLLALKLAVPFIYSLRFSPASTVERHCGKIPAPPSYTPAALSELTDRMSFSERIKNIVSYHLQDYVFQSYWGEWDIYYSKVLVLVWPADNSHWLNMEYILQELVVRGHEVTVLLPSCFLILNPAEPSPFRFEVVEVPITKKEMATLLEEALYFWFYQESALPVWVSLYKIAQLVYKLENVTKIICDEVLKNEALLERLRTSTFDVLLADPLAPSGELFAEKLGIPFVYTIRFSIGNTVERLCGTLPAPPSYVPATLSRLTDRMSFLERLKNIFTFIVQDIMYHYLLWGSWDQYYSDVLGRPTTLCETMGKAEIWLIRTYWDFEFPRPFLPNFEFVGGLHCQPAKPLPKVLWRYKGKKPETLGSNTRIYDWIPQNDLLGHPLTKAFITHGGTNGIYEAIYHGIPMVGIPIFADQHDNIAHMRAKGAAVELDFSTLKTQDLVDALNTVINNSTYKENALRLSKIHHDQPVKPLDRAVFWIEFVMRHKGAKHLRPAAHHLTWYQYHCLDVLAFLFTCTAIAAFILVKCCLFCCNRCGRIAKRKKE

SEQ ID NO: 8413 - protein, 359 aa, Bison bison
MNMMAVKRLLLLLLLQLTCYFSSGSCGKVLVWPVEYSHWMNMKIILDELVMRGHEMLNEKKWDQFYSEVLGRPTTLLETMGKAEFWLFRSYWDFEYPCPLLPNVEFIGGLHCKPAKPLPKEMEEFVQSSGENGIVVFTLGSMVTNVTEERANMIASALAQIPQKVLWRYDGKKPDTLGPNTRLYKWVPQNDLLGHPKTKAFITHGGTNGIYEAIYHGVPMVGLPLFAEQPDNINRVKAKGAAVRLNLETMSKTDFLNALKQVINNPSYKRNAMWLSTIQRDQPMKPLDRAVFWIEFVMRHKGAKYLRPAAHKLTWFQYHSLDVIGFLLACVATAVFVITKCFLFCCRKFAETGKKRKRE

SEQ ID NO: 8414 - protein, 530 aa, Propithecus coquereli
MAVKLASALLLIQLSDYFSSGTCGKVLVWPTEYSHWMNMKTILDELVQRGHEVTVLTHSASILIDPKKAASIKFEAFPTSLTKSDFEDVAIQLVHKWTYDLPKATFWSYFSQVQEIMWTFSEIMIKFCKDAVSNKKFMTRLQESKFDVVLADAIGPCGELLAEILQTPMVYSLRFSPGYTFEKYGGGLLLPPSYVPVAMSELSDQMTFMERVKNLIYMLYFDFWFETFNMKKWDQFYSEVLGRPTTFYETMKKADMWLIRTYWDFDFPHPLLPNFDFIGGHHCKPAKTLPKDMEDFVQSSGENGVVVFSLGSMVSNMTEERANVIASALAQIPQKVLWRFDGKKPDTLGPNTQLYKWLPQNDLLGHPKTKAFITHGGANGVYEAIYHGVPMVGIPLFADQPHNIAQMKAKGAAVRLDFETMSSTDLCNALKTVINDPIYKENAMKLSRIHHDQPMKPLDRAVFWIEFVIRHKGAKHLRVAAHDLTWFQYHSLDVIGFLLACVATVIFIITKCCLFFCRMFATAGKKKKRE

SEQ ID NO: 8415 - protein, 744 aa, Parus major
MAMKTTGSKKYLQLLLFQVALLGPVFCGKILVWPTEGSHWMNMNVIIQELIRRGHSFTILVSNATLYIEPRPKATEKFETYYVPFKKDVPENLINGIVDLWLNNRPTVLTFWQFYKELGRLSVGWQEMNKMMCDAVLTNQELMARLQGSGFDLMLSDPVTPCGELVAVKLGIPFVYSLRFSPAFTLERHCGKIPTPPSYTPAALSELTDHMSFGERVKNFVSYHLQDYVFQSYWGHWDIYYSKALADNSHWLNMEHILQELVVRGHEVTVLLPSCFLIVNPTEPSPFQFEVIEVSITKKEMADLMEEILYFFFYEERELPIWKSAYKIAQKTLQMKNITKIICDGVVKNEALMERLRASAFDVFLADPLFPSGELVAEKLGIPFVYTFRFSMGNTVERICGTLPAPPSYVPTTLTGLTDRMTFWQRLKNFLSYALQDFMFHYFWRAEWDGYYSNVLGRPTTLCETMGKAEIWLIRTYWDFEFPRPYLPNFEFVGGLHCQPAKPLPKEMEEFVQSSGEHGVIVFTLGSMVHNLSDERSNVIAKALSQLPQKVLWRYKGKKPETLGSNTRIYGWIPQNDLLGHPLTKAFITHGGTNGLYEAIYHGIPMVGIPMFADQHDNIAHMVAKGAAVQVDFNTMKTQDLVDALNTVIYNSTYKENALKLSKIQHDQPVKPLDRAVFWIEFVMRHKGAKHLRPAAHHLTWYQYHSLDVLAFLFTCTATIVLILFKCCLCCCRRCGRIAKRKKE

SEQ ID NO: 8416 - protein, 531 aa, Oryctolagus cuniculus
MSMKHSSVLLLLLQLSCCFSSGSCGKVLVWPMEYSHWMNMKTILDALVQQGHAVTVLRSSASVLIDTKNESGIKFETFPTTSTKEEMEAFFMYWIKTLINDVSREKYWEYFPLWHKFFLEYSNTYENLCKDLVLNKKVLAKLQESRFDVVLADAIAPCGELLAELLEVPLVYSLRFTPGYTYEKYSGGLLFPPSYVPIIGSNLSGKMTFMERVKNTLWMLYFDFWFQTFDEKRWDQFCSETLGRPVRFSELVGKAAMWLIRSYWDLEFPRPLLPNVEFVGGLHCKPAKPLPKEMEDFVQSSGEEGVVVFSLGSMVSNMTEERTNVIATALAQLPQKVLWRFDGRKPETLGPNTRIYKWIPQNDLLGHPKTKAFVTHGGANGIYEAIHYGIPMVGLPLFGEQPDNIAHMTAKGAAFRLNWKTMSSADLFNALKTVINDPSYKENVMKLSRIHHDQPMKPLDRAVFWIEFVMRHKGAKHLRVAAHDLTWFQYYCLDVIGFLLACVTITTYVVIKFCLFAYQKIITTGNKIKRD

SEQ ID NO: 8417 - protein, 530 aa, Nannospalax galili
MSVKLSSVLLLTQLICYFRSGTSGKVLVWPTEYSHWINVKMILDELVERGHEVTVLTSSASILIDPSKPSTIKFEIYPTSLSKDDLANMFLKWITEWMHDFGKYSFWTFYSNIQKSFNEYSDVVENFCKAVVRNKGLMKKLQESRFDVVLADAFGPCGELLAEILKIPFVYTLRFCPGYTYEKYSGGLSFPPSYVPMVLTGLTDHMTFVERVKNMMYVLYFDFWFQTFNEKKWNQFYSEVLGKPTKLSELMGKADMWLIRTYWDLEFPRPFLPNSEFVGGLHCKPAKPLPKEMEDFVQSSGEHGVVVFSLGSMISNMTEEKSNVVASALAQIPQKVLWRFDGKKPDTLGSNTRLYKWMPQNDLLGHPKTKAFVAHGGTNGMYETIYHGIPVVGIPLFADQHDNIARMVAKGAAVRLDYSTLSTTDLLTALRTVINDPSYKENAMKLSRIQHDQPVKPLDRAVFWIEYIMRHKGAKHLRPALHDLNWFQYHSLDVIGFLLACGAAVVFIITKFCLFCCHKVAKAEKKKKRE

SEQ ID NO: 8418 - protein, 523 aa, Camponotus floridanus
MKLLSILFAILICDQVVDAYRILGIFPLNGKSHWIMQEELMKGLAKRGHQVDVVTHFPQKKPISNYTDISLAGSLPSIMNNMTATRIKAVSVISIGSLVHTTGIEVCQLMDHPKIQELIRNPPQNPPYDIVITELFMAPCYLAFGRHLNVPIVATVASVFHDWLNEVSGNPLNLAYIPSFFSTYTQRMSFTQRVANVILSNYISAQIHYQTNSQLEFVKKHFDIDVPHIKDLYRDIALYLVNTHHSLHGIRPMTTNVIEVGGVHLKDDDPLPPEVQKWLDESKNGCIYFTFGSMVRIETFPKEIIEQFYASFEKIAPVRVLMKVAKKEDLLPGLPKNVMTQSWFPQISVLKHKHTRGFITHGGGLGTQESIYCGVPMIGIPLFGDQHINIQNYVNKKVAVAFESIYDVTEEKLTSALNKILRDPSYYENVQRLSKLFVDRPMSALNTSIFWIEYIGKHGNVLQSPAIDLYWWQLNLLDVYAFIVAVIIIALCIVLFVLRKLKNFLFGSPARKDSAAIKLKKNK

SEQ ID NO: 8419 - protein, 529 aa, Chinchilla lanigera
MSRIMKTILLLLHLCCYFSAGRCGKVLVWPMDYSHWLNIQVILTELVQRGHEVTVLRPSSSVFLYLNSPSDIKFETFLTSSNTEDMKNFFERTLDTWIYTVPKDTYWKHFPRLQGLLWEFSDVYYNITEGAVRNKKLMTKLQDSKFDVLLADAIFPGGDLMAELLKIPLVYTLRFSPGYTYEKYNAGLLFPPSYVPVILSRLSSQMTFMERVKNLMHLLYFDFWFQTFNEKKWSQFYTEILGRPTTLSQSMAKAEMWLIRSYWDLEFPRPTLPNTEFVGGLHCKPAKPLPKEMEEFVQSSGEHGIVVFSLGSMVHNLTEERANVIALALAQLPQKVIWRYSGKKPDTLQPNTQLYEWIPQNDLLGHPKTKAFVTHGGANGIYDAINHGVPMVGIPLFGEQHDNIAHMEAKGAAVVLDFMTMSTADLVNALKEVMNNPSFKENVMWLSTIHHDQPMKPLDRAAFWIEFVMRHKRANHLRPLAQNLTWYQYHSLDVIGFLLACVVTVTLLVTKCCFFCYQKIVKTGKKKKE

SEQ ID NO: 8420 - protein, 278 aa, Erinaceus europaeus
MATSHYGQQPFSASGRQGEKGQKRERRKQEGSIWQKPEVEIEEFVQSSGENGIVVFTLGSMIKDMSEERANMIASALAQIPQKVLWRFDGKKPDTLGSNTQLYKWIPQNDLLGHPKTRAFITHGGTNGIYEAIYHGVPMVGIPLFADQPDNIAHMEAKGAAVRVDLETLTSADLLNALRKVINDPLYKKNAMWLSAIQHDQPVKPLDRAVFWIEFVMCHKGAKHLRPALYNLNWFQYHSWDVIGFLLACVAIVTFFVIKCCLFCCAVFVKTSKKKKRE

SEQ ID NO: 8421 - protein, 786 aa, Drosophila grimshawi
MHLQALRLALLCSVLGALTQVRPVDGAKILAVYAFPGKSHYMMHTALIRELIESGHQVTMIAAFSLESQQLGSNYTELLIEPVYDFWHDVKLNFGVQHLFDLTRMKNYDFLKMLEIIGLKTTEHALLQPKVQSLIHATETEGVFDLLLAEQFYQEAFLALAYKYNIPIVTTSTLGYENHMSQMMGLITPWSFVPHGFMPFTDRMSFLERLRNTYVSLYEDLDRLYNYFPKMDNLAKQHFGNVLADVPKVRQMEKQISQPKNVLKFLLLGFVALQHFEIGAGSRILAAFFFPGKSHFMMTNAIIRELVQRGHEVTFITPFTLANENLGSNYTEVLLPQFNIWRTILEMSKGKSVLDMTDMDTLTFIKMAMVMGSETTNFAFEQKEVLNLINAKDKVGKFDLLLAEQFFNEGALLLGHLYQIPIITMSTFGFANYLSPLVGIVTPWSYVSHGWKPYSDRMSLSERIDNVYSSLMEDIIRQFWYYPAQNEILQRHFSKQFKDLPTIKQLESNISVILLNAHMPLEPPRPLSFNMIPVGGLHIKPAQPLPTEMQKFLDEAEHGAIYFSLGSQVKSADLPPEKLKIFLDVFRSLKQRILWKFEDDKLPNKPANVMVQKWMPQSDILAHPNVKVFISHGGLFGTQEAVYHGVPVLGMPVYADQYLNINKGKVAGYALGVDYRTVTEEELRYSLTELLENPKYRDTMRRASRIFRDRPLSAMDTAMFWIDYVIEHRGAPHMVSEGINLPWYKFYLLDIIGIALAIVLLPILGLFLICRSFKSNKKQKPKSKRH

SEQ ID NO: 8422 - protein, 401 aa, Colobus angolensis
MSVKWTSVILLIQLSFYFSSGSCGKVLVWAAEYSHWMNMKTILEELVQRGHEVTVLASSASILFDPNNSSALKIEVFPTSLPKPEFENLVTQEIKRWLDLPKDTFWLYFSQMQEIMWKFGDIFREFCKDVVSNKKLMKKLQESRFDVVFGDPIFPCRRPTTLSETMGKADIWLIRNSWNFQFPHPLIPNVDFVGGLLCKPAKPLPKVLWRFDGNKPDTLGLNTRLYKWIPQNDLLGHPKTRAFITHGGANGIYEAIYHGVPMVGIPLFADQPDNIAHMKARGAAVRLDFDTMSSTDLANALKTVINDPLYKENVMKLSRIQHDQPVKPLDRAVFWIEFVMRHKGAKHLRVAAHDLTWFQYHSLDVIGFLLACVATVIFIIMKCCLFCFWNFARKAKKGKSD

SEQ ID NO: 8423 - protein, 539 aa, Peromyscus maniculatus
MSTAFHFSKMSMKQTSVLLLIQLICYFRVGTCGKVLVWPTEYSHWINIKMILDELLQRGHEVTVLTSSASVLIEPSKESSINFEIYPVPLSKDDLQYTFEEWVTRWTYDFQKPSLWIYYSKMQQIFNEYSDVIESFCRAVVWNKSLMKKLQGSKFDVILADAVGPCGELLAEVLKTPLVYSLRFCPGYKCEKYSGGLPLPPSYVPVVLSELTDHMTFVERVKNMLQVLYFDFWFQPFNEKTWSQLYSDVLGRPTTLYEIMGKADIWLIRTYWDLEFPHPLLPNFEFVGGLHCKPAKPLPKEMEDFVQSSGEHGIVVFSLGSMVRNLTDEKANIVASALAQIPQKVLWRFDGKKPETLGSNTRLYKWIPQNDLLGHPKTKAFIAHGGTNGIYEAIYHGIPIVGIPLFADQPDNINHMVAKGAAVRVDLDTLSTTDLLTALRTIINDPSYKENAMRLSRIQHDQPMKPLDRAIFWIEYVIRNKGAKHLRVAAHDLTWFQYHSLDVLGFLLACVVTVMLIIMKCCLFCCRKFSKAGKKKKRE

SEQ ID NO: 8424 - protein, 527 aa, Tupaia chinensis
MLNNILLLSLQLSLLGNALGGKVLIWPMEGSHWLNVKIIIDELIKKDHNVTVLLYSGALFIAPTVNPSLTFEIYNVPFGKERIEGVIKDFVLTWLENRPSPSTIWRFYQEMAKVIEDFHMVCREICDGVLKNQKLLEKLKKDEFEVLVSDPVFPCGDIIALKLGIPFMYSLRFSPASTVEKHCGKVPFPPSYVPAILSELTDQMSFADRVRNFISYHLQDHMFETLWKSWDSYYSQALGRPTTLCEIMGKAEIWLIRTYWDFEFPRPYLPNFEFVGGLHCNHSKPLPKEMEEFVQSSGEDGIVVFSLGSMVKNLTDEKANIIASALAQIPQKVLWRYKGNKPAALGANTRLYDWIPQNDLLGHPKTKAFITHGGTNGIYEAIYHGVPMVGIPMFADQPDNIAHMKAKGAAVDVNMNTMTSADLLNALKTVINEPSYKENAMRLSSIHHDQPVKPLDRAVFWIEFVMRHKGAKHLRVAAHDLTWFQYHSLDVIGFLLACIISAMFLVTKCCLFFYKKFHKTEKKKKRE

SEQ ID NO: 8425 - protein, 412 aa, Galeopterus variegatus
MSMKWNSVLLLLQLSCYFSSGSCGKVLVWPTEYSHWMNMKTILDELGQRGHEVTVLTSSASIHVDPNKTSTIKFEVYPTSLSRDAFDAFVLMVVKKWERIPKDRFWFQTFNLKEWDQFYSEVLGRPTVLLETMAKAEIWLIRSYWDFDFPRPLLPNFDFVGGFHCKPAKPLPKEMEDFAQSSGEHGVVVFTLGSMISNMPEERANVFASALAQIPQKVIWRFDGKKPDTLGANTRLYKWIPQNDLLGHPKTKAFITHGGGNGVYEAIYHGVPMVGMPLFADQPDNIARMMAKGAAVRLDFDTVSSTDMLNALKTVINDPLYKENIMRLSRINHDQPTKPLDRIVFWIEFVMRHRGAKHLRVAAHDLNWVQYHSLDVIGFLLACVATVIFAITKCCLLCCQKFAKTGKKEKRE

SEQ ID NO: 8426 - protein, 508 aa, Anopheles sinensis
  MOD_RES (32)..(39): Any amino acid
MMFLRLQLMLVAFVAGSRGANILFMSAIPSTXXXXXXXXKSFLKIIQIFMDRLRPLIYELGKRGHNVTVISADIEKQPPANVSYIHLENLYSATYNTSFRQNVDFFNLASQGPIPMLGLIHGIGLHMCEAGIKSEGMHFLLNYPKDFKFDLFVNDFMIGPCLPSIIMHRFKDVPYIPATAYNAPSTGAPVLGSYAYSGLVPNHVYDVPEVMSFVQRVKNFYYDAYEMITHETNMHPEADRILRTIYPSAPSTTTFYKNVRVSFINANPIIQYKEPMMPNMIPVGGLQIQPPKPLPEDLRKVVDGARNGFILFSLGSNARSDLLGPERIRNILTAMGRLPQYQFFWKFESDQSKLPMAVPKNVFIRAWMPQNDLLAHPNIKLFITHSGLLSTQEAIWHGVPVIGFPVFTDQFRNINYCVNVGIAKRLSIHDFQANELVDAVKKILGEPKYATKMKQVSRLFRDQPETPLERAVWWCEWVLRNPDADLLQSRAVHLNKKIKERVIVKENT

SEQ ID NO: 8427 - protein, 505 aa, Helobdella robusta
MLSHVLEQVAAGKVLLKAGHEVHLILDSRFDPSLVKKFQNDGFRLHFFKAPTSFVTFSSEEYKKHLGDQIFNANVDFYTHLAIVGEQVNEECGYMLEDKKFIDELKDVGFDLAIPEPFAVIMCPLIIPKYLKIPFVSLTNLYFAFQIRSPALPTYYLRHFQTADDKREMSFFVRFKQLLVIIFFSSRLSPLNRNLTLLHKYAPEFATWDELLRESLLFFYEVDHHFTNFLPAFPNHISVAGLTCSPAKPPPENILNFINSRIVNGKDPGVIVMTFGSSADYMPRGIVKKFFNVFSQLNETIIAKFTIKKTDKELLALVPPNLLILNWLPQNDLLGHPSTKLFITHCGNNGQHEALYHGVPMLGFPLFAEQHMNARRMTVKGFGLGMNILTFTESDLLQNILEIEQNPNYRSSIKLASKAFRDQPMTAQERILFWIEHVIKHGGAHLRSGAMDLPLYQFLCFDTVGTLLLIVIVIIVVTLKLSVHCVEKFIRCYKIRFCKKKEKEL

SEQ ID NO: 8428 - protein, 423 aa, Acropora digitifera
MLIEAGGPSWEFLSYVMNIKKVTCELMLNNTDFLGDLKGFDLMVHDSMELCSVMLAQYLGIQRVEVIPASPNGFFAWAHMIPMPVSYIPQVVPGYSDKMTFLQRVVNLGASVSIGWFQFLLSQTMNNIKIKYNIKPEQSLWEAQNEAELCIITADFALEYPQPLLPGNIMVGPLNAKDSQPLPNELEAFVNNSDHGFIVVSFGSNVGFLAKEKVDTMAIAFGKLKQKVVWRLKGHIPSSLRPNIKVSEWLPQNDLLGHEDVRAFVSHVGHNSLYESAYHGVPLIAFPLFGDQAYNAKRVEYFGLGLSVDHKTFDDEHLFQRIENVIYDPRFKNAAIRVSKLLRDRQRTPLQTTGDWVEYVLKHGGARHLRAQVFYLSWYQYYLLDVIFFLVTIVIVVGMAIRLAFKCLCRLCCCQRGSKSKKE

SEQ ID NO: 8429 - protein, 412 aa, Chrysochloris asiatica
MSVKWVPLLLVIQLSCYFSSGRCGKVLVWPTEYSHWINIKTILDELIQRGHEVTVLTSAASVLINPNMASAIKFEVYPTSFNKEEIEISFMSWINEWTRKSKDDFWFQTFNEKKWDQFYSEVLGKPTTLSETMGKAEIWLIRTYWDFDFPRPFLPHFDFVGGLHCKPARPLPKEMEEFVQSSGKHGIVVFTLGSMVRNITEEKARMIASALAQIPQKVLWRFDGKKPDTLGSNTRLYKWLPQNDLLGHPKTKAFITHGGTNGIYEAIYHGIPLVGIPLFADQPDNIAHMKTKGAAVSLNIDTMTSTDLLNALKTVINDPFYKENAMRLSAIHHDQPVKPLDRAVFWIEFIMRHKGAKHLRPASHDLTWYQYYSLDVIGFLLACVAIVTFVIIKCCLFSYKKLFKRGKKKKRE

SEQ ID NO: 8430 - protein, 530 aa, Rattus norvegicus
MSGKWISALLLLQISFCFKSGNCGKVLVWPMEYSHWMNIKIILEELVQKGHEVTVLRPSAFVFLDPKETSDLKFVTFPTSFSSHDLENFFTRFVNVWTYELPRDTCLSYFLYLQDTIDEYSDYCLTVCKEAVSNKQFMTKLQESKFDVVFSDAIGPCGELIAELLQIPFLYSLRFSPGYTIEQYIGGVLFPPSYVPMIFSGLAGQMTFIERVHNMICMLYFDFWFQTFREKKWDPFYSKTLGRPTTLAEIMGKAEMWLIRSYWDLEFPHPISPNVDYIGGLHCKPAKPLPKDIEDFVQSSGEHGVVVFSLGSMVRNMTEEKANIIAWALAQIPQKVLWRFDGKKPPTLGPNTRLYKWLPQNDLLGHPKTKAFVTHGGANGIYEAIHHGIPMIGIPLFAEQHDNIAHMVAKGAAVEVNFRTMSKSDLLNALEEVIDNPFYKKNAMWLSTIHHDQPTKPLDRAVFWIEFVMRHKGAKHLRSLGHNLPWYQYHSLDVIGFLLSCVAVTVVLALKCFLFVYRFFVKKEKKTKNE

SEQ ID NO: 8431 - protein, 526 aa, Geospiza fortis
MAGKEVAVLVLLAVLGWGSGGKVLVWPADNSHWLNMEHILQELVARGHEVTVLLPSCFLIVNPTKPSPFQFEVIEVPITKKEMTDLMDKMFYFFFYEEKGLPIWKGTYKMVQMVLQMKNITKIICDGVVKNEALMERLRASAFNLFLADPLFPSGELVAEKLGIPFVYTFRFSMGNTVERLCGTLPAPPSYVPTTLTRLTDRMTFWQRLKNILGYALHDFMFHYLLWANWDQYYSEILGRPTTLCETMGKAEIWLIRTYWDFEFPRPFLPNFEFVGGLHCQPAKPLPKEMEEFVQSSGEHGVIVFTLGSMVHSLSDEKSNVIAKALSQLPQKVLWRYKGKKPETLGSNTRIFDWIPQNDLLGHPLTKAFITHGGTNGLYEAIYHGIPMVGIPMFADQHDNLAHMVAKGAAVQVDFNTMKTQDLVDALKTVIYNSTYKENALKLSKIQHDQPVKPLDRAVFWIEFVMRHKGAKHLRPAAHHLTWYQYHSLDVLAFLFTCTATIVFILFKCCLCCCRRCGRIAKRKTE

SEQ ID NO: 8432 - protein, 532 aa, Bos mutus
MHKMSMQWLSLLLLLQLTCYFNSGSCGKVLVWPMEYSHWMNMKTILDELVTRGHEVTVLTPSVTTFIDPKKPSSLKLETFPPSLTKEESENFVKLFVEAWMHAVRDSFWNHLSMVQSLFWGYSDILMKMCKEVVSNKKLMTKLHEERFDVIFADAVGPCGELLAEILKIPFMYSLYSTPGSSVEKKSGRLPFPPSYVPAMFSELSDHMTFMERVKNMIYVLYFDFWFQAYNEKNWNQFYSEVLGKPTTLVETMGKAEMWLIRNYWDFSFPRPRLPNFEFVGGLHCKPAKSLPKEMEEFVQSSGENGIVVFSLGSMVSNMSKERANVIASALAQIPQKVLWRYDGKKPDTLGPNTQLYKWIPQNDLLGHPKTKAFVTHGGSNGIYEAIYHGIPIVGLPLFADQPHNIVHMKAKGAAVRLDLETMSTEDLLNALKEVINNPSYKENMMRLSAIHHDRPVKPLDLAVFWIEFVMRHKGAKHLRPAVHNLTWLQYHSLDVIGFLLACVATGAFVITKCCLFCYQKFAGKGKKGKKD

SEQ ID NO: 8433 - protein, 531 aa, Tetraodon nigroviridis
LLAWSPSEVWTAKIIVVPPIMFESHLYIFKTLATALHGEGHETHLLISEGREVSLSPYYHLQRYPGIFNSITADNFLQSKVRNIFSGRLTFLELFDILDHYSQNCDAVVGNNEVMTRLKEAKFDLLLVDPNEMCGFVIAHILGVQYAVFSTGLWYPAEVGAPAPLSYVPEFNSLLTDHMTLFERITNTVVYLAQRFGVQYIALPKYDRIMKKHGVKPQVAMSDLVQGSRLWMLCTDMALEFPRPTLPHVVYIGGILTKPPNPLPQDFEAWVNDTAEHGFVVVSFGAGVKYLSQDITQKLAGALARLPQRSLEFHPITCGKNIKLVDWMPQNDLLGHANTRAFLSHGGLNSIYEAMYHGVPVVGVPLFGDHYDTMTRVAAKGMGIMLHWKYMSENDLYTALTSVITDKRYRQQAQLLSNIHKDQPGHPVTRAVYWINYILRHNGASHLRSAVYKVSPYQYFLLDAILTIGAVLALVGFSLRQVFRLMCGRVRNQSDATRDGSVTSNGHCHSESMVNGKHKGNGLLKNEKKIN

SEQ ID NO: 8434 - protein, 280 aa, Bison bison
MGKADMWLFRSYWDFEFPQPYLPNTEFVGGLHCKPAKPLPKEFEEFVQSSGKDGVVVFTLGSMIKNLSEEKSNMIASALAQIPQKVLWRYTGKKPETLGANTRLYKWIPQNDLLGHPQTRAFITHCGTNGIYEAIYHGVPMVGIPMFGDQHDNLARMKAKEAAVEVDLQRMTSADLLNALKAVINNTSYKENAMKLSRIHHDQPVKPLDRAVFWVEFVMRHKGAKHLRPASHDLNWFQYHSLDVIGFLLACVATVAFLVTKCCLFCCWKFGKTAKKKKRE

SEQ ID NO: 8435 - protein, 528 aa, Ochotona princeps
MKMLAFLLLLQLSFHFNPVNCGKVLVWPMEYSHWMNMKTILDALVQRGHAVTVLRSSASILIEPSNESGIVFETFPSPSTKDEMEAFFLNSINTMIYDVSRDAYWEYFPLMQESILEYSNMHESSCKEVVFNKKIMAKLQASKFEIVLADTIAPCGELLAELLEIPLVYSVRFTPGYTYEKYSGGLLFPPSYVPVIMSDLSGQMTFTERVKNMLFMLYFDFWFQTFNNKRWSQFYSEALGRPVTLSELMGKAEIWLIRSYWDLEFPRPLLPNFYFVGGLHCKAVQPLPKEMEDFVQSSGEEGFVVFSLGSMISNMSEERANVIASALAQLPQKVIWRFEGKKPNTLGNNTQLYKWIPQNDLLGHPKAKAFVTHGGANGIYEAIHHGVPMVGLPLFGEQYDNLAHMKAKGAAVRLDWKTMSSTELFNALKTVINDPFYKDNVMKLSRIHHDQPMKPLDQAVFWIEHVMRHKGAKHLRVAAHDLTWYQYYSLDVMGFLLVCVTIISYLVIKFCMFSYQQIVMNGKKKKRD

SEQ ID NO: 8436 - protein, 529 aa, Miniopterus natalensis
MAMKWIFILLLLQLSCHVRPGWCGKVLVWPTEYSHWMNMKTILDELVQRGHEVTVLTSSASILVDPNKPSAINFEIYPTSLTKDDFEHIFMQVLSKWIYIPDDTFFSYFSQMQDMLWELYISFRKLCKDVALNKKLMTKLQETRFDVILADPFGPCGELLAEVLKIPLVYSLRFTPGSTIEKHIGGLPFPPSYAPVVLSELSDQMTFMERVKNMIYVLYFDFWFQTFDQNKWDQLYTEVLGKPTTLFELMSKAEMWLIRTYWDFEFPRPFLPHFVFVGGLHCKPAKPLPKEMEEFAQSSGQNGIVVFTLGSMVSNISEERANVIASALAQIPQKVLWRFNGKKPDTLGPNTRLYKWIPQNDLLGHPKTKAFITHGGTNGIYEAIYHGVPMVGIPMFADQPDNIARMQTKGAAVRLDFNTMSSADLLNALKTVINDPSYKENAMRLSRIQHDQPMKPLDRAVFWIEFVMRHKGAKHLRPASHDLTWFQYHSLDVIGFLLACVATAIFVITKCVLFCCQKCANPGKKGKRE

SEQ ID NO: 8437 - protein, 485 aa, Colobus angolensis
MSVKWTSVILLIQLSFYFSSGSCGKVLVWAAEYSHWMNMKTILEELVQRGHEVTVLASSASILFDPNNSSALKIEVFPTSLPKPEFENLVTQEIKRWLDLPKDTFWLYFSQMQEIMWKFGDIFREFCKDVVSNKKLMKKLQESRFDVVFGDPIFPCSELLAELFNTPLVYSLRFTPGYGFEKHCGGFIFPPSYVPVIMSELSDQMTFMERVKNMIYMLYFDFCFQMYDMKKWDQFYSEVLGRPTTLSETMGKADIWLIRNSWNFQFPHPLIPNVDFVGGLLCKPAKPLPKVLWRFDGNKPDTLGLNTRLYKWIPQNDLLGHPKTRAFITHGGANGIYEAIYHGVPMVGIPLFADQPDNIAHMKARGAAVRLDFDTMSSTDLANALKTVINDPLYKENVMKLSRIQHDQPVKPLDRAVFWIEFVMRHKGAKHLRVAAHDLTWFQYHSLDVIGFLLACVATVIFIIMKCCLFCFWNFARKAKKGKSD

SEQ ID NO: 8438 - protein, 514 aa, Alligator mississippiensis
MYATFVLGKMCFWHSGSCGKVLVWPTDASHWINLKMILGELILRGHDVTVLVPSATLLIDYDDPTSPFDFEVLKVPFTKETVKTVLQDFLSLCLYEKPHLSHWEALVKIRQMMTTFTKMSKQTCDGFVLNPKLITKLRHGGFDVLISDPLAPGGELVAEVLEIPFVYTFRFSEGNTLERLCGGIPAPPSYVPASTGELTDRMSFLERLTNFLLYLYNDALYLYFWEDEWNQYYSNVLGRPTTLCETMGKAEMWLIRTYWDFEFPRPYLPNFEFVGGLHCQPAKPLPEEMEEFVQSSGEHGIVVFSLGSMIHNLTDEKNNMIATALSQLPQKVLWRYKGKKPETLGTNTRIYDWIPQNDLLGHAKTKAFITHGGTNGIYEAIYHGVPMVGIPIFADQPDNIAHMRAKGMAVELDFNTMKAQDLVDAVNMVVNNFTYKENAIRLSQIHHDQLVKPLDRAVFWIEFVMRHKGAKHLRPAAHQLTWYQYHCLDVLAFLLTCATVTLFIAVKCCLFCYL

SEQ ID NO: 8439 - protein, 530 aa, Propithecus coquereli
MALQWTSVLLLIQLCGYFSSGTCGKVLVWPTDYSHWMNMKIILDELVQRGHEVTVLASSVSVVIDPSKTSAIKFELFPTSLSKDDFDGFLMKLLDRAIYGVPKDTFWSPVSQIEEIMREFSEVLRKLCEDAVLNKKLMTKLQESKFDVLLADGVGACADLLAEILKTPLVYSLRFSPGYTFEKYSGGLIFPPSYVPVAMSELSDRMTFMERVQNMIYMLYFDFWLQAYDVKKWDQFYLEVLGRPTTIYETMKKADMWLIRTYWDFDFPRPLLPNFDFVGGLHCKPAKPLPKEMEDFVQSSGENGVVVFSLGSLISNMTEERANVIASALAQIPQKVLWRFDGKKPDTLGRNTRLYKWLPQNDLLGHPKTKAFITHGGANGIYEAIYHGVPMVGIPLFADQPDNIARMKSKGAAVRVDFNTMSSADLLNALKTVINNPIYKENAMKLSRIQHDQPVKPLDRAVFWIEFVMRHKGAKHLRVAAHDLTWFQYHSLDVIGFLLACVATVVFIITKCCLFFCRMFATAGKKEKKE

SEQ ID NO: 8440 - protein, 537 aa, Drosophila yakuba
MAGISRCLALHIVLLLAGAHGANILGLFTSLSPSHLVIQMSMARILAEQGHNMTVVTVLKPPSLHKNINHILVPMNEDTLSTFSSLVGGMTKTDNSNAIVSMFRSLKVISEAFSKMGDVMKQPLIRDLYEHADNKFDLVLMGYFMNSYQLAVAHKLKVPVVVAVSNPPSFLGYVLGNPWEVSYVPAMNMAIESGQSMGIGHRALNLLGSLGSRLFMYVIELKNTKIYREIYGNDPTLPSYEDLNKNISLIFFASHGISEGPIRPNVPAVIEVGGIQVKEQPDALPENMEKFLSEAPQGAILLSLGSNVKQDHLSTDTVQKMYNVLSKLQQKVIWKWDDLENVPGRSENILYSKWVPQDDVLAHPNLTLFITHAGKGGITEAQYHGKPMLALPVFGDQPANADVMVRQGFGLKQSLLTLEEDSFLQGIREVLENPKYANAVKSFSTLYRDRPMSARESLIYWVEYVMRYHGAAHIQSPVVHMSYIAAHNLDVYAVILGTIVALCFITKLVFGLVFRKLRQSSGKPKVNQQRKLKKKQS

SEQ ID NO: 8441 - protein, 528 aa, Anopheles sinensis
MASSTTVKWLLLLIGYFGTNTLAANILYFNTVASPSHFVWNRALIYALAGAGHNLTVFSVDNDTKPPPNVTFILLEDVYKKLNSEGDVDTDYLAMIKTGPFAMLSIYNNFMLGVCKLALEAEGAKRLYEYPEDFGVDLIMYDYFTGPCMAALAHHRFGKPPVVAVTAYHGLSTSSHISGAFHYSALVPNHAYDAMEEMTYCQRFKNLLLNIWEDLLQRHNLIPKTNQLLRQYDPTLPDVTEFNRETKVVLLNANPVIQFTEPVMPNVIPVGGLQIIKPKPLPDDLAKILEQAPPGGVVLFSLGTNVRSDKLGKTRITAILDAMEALPEYHFIWKFESDSMPRALPPNVHLRKWLPQNDLLAQPKVRLFITHSGLLSTQEAIWHGVPMIGFPVFADQFKNINYCMAKGVGKRLSIEHINTKELVDTIKEVMAKESYRTNMKRMSELFRDQPEHPLDRAVWWIDWVLRHPDSTELLTHGTRFHWFVKYSYDVLVPLLAAIAIVCHLVIFTVRRVVFSQKTAPKGVKQKRS

SEQ ID NO: 8442 - protein, 530 aa, Dasypus novemcinctus
  MOD_RES (194)..(194): Any amino acid
MVTEKRVSALLLLQLCCVGCGFCGKVLAWPCDLSHWLNMKIILEELIERGHEVTVLAPSPSFLIDYSKPSTMNFKTITMPNNGENAKNLLNEFLDVAINVMPKMSYWQSAMKLQDFILQTTGDVKFFCESIVYNQTFMKNLKETNYNVMIIDPIVPCGELIAELLAVPFVHTLTTSIGGTFERHCRKIPAPLSXVPVPLVELEDKMTFLERVKNLMLSFLCDFWLQQYDIQFWDQFYSEALGRPTTLCETMGKAEMWLIRTYWDFQHPHPYLPNFEFVGGLHCKPAKPLPKEMEEFVQSSGEDGVVIFSMGSMIKNFPEDKANLIASALAQIPQKVLWRYQGKKPNTLGANTRLYEWIPQNDLLGHPKTKAFITHGGMNGLYEAIYHGVPMVGIPLFVDQPANIAHMKAKGAAVDMNFNTMTSADLLRALKTVINEPSYKENIMRLSRIHHDQPVKPLDRAVFWIEFVMCHKGAKHLRPAAHDLTWFQYHSLDVIGFLLACVATAVFLVTKCCLFCCQKLDKIGKKRKRE

SEQ ID NO: 8443 - protein, 299 aa, Chinchilla lanigera
MKAIKCEMVAGKPTTLYEKMKQADMWLIRSYWDLEFPRPTLPNVDFVGGLHCKPAKPLPKEMENFVQSSGEHGVVVFSLGSMVSNMTEERANVIASALAQIPQKVLWRFDGKKPDTLGPNTRLFKWLPQNDLLGHPKTRAFITHGGANGVYEAIYHGIPMVGIPLFAEQFDNIAQMEAKGAAVKLEFKSLSTTDLLNALKTVINNPFYKSNAMKLSTIHHDQLMKPLDRAVFWIEFVMRHRGAKHLRPLAQNLTWYQYHSLDVIVFLLALVAIIIFLVLKCCLFCFQKFAKVGKKKKRE

SEQ ID NO: 8444 - protein, 529 aa, Bos taurus
MKTVKGFCILFMLHLCLLDSGRMGKVLVWPVDFSHWINLQFILEELHIHGHEITVLVPSQNLLIDHTKVPYHVEILQLSVTEETFMEEFNSMLYEEIFELPKLSWWEMQIKLADLVKKFLLTNKRVCDSAITNKELLSRLQAANFDVCIADPLSFCGELVAELLNIPFVYTFRFFYGNAIERLCAGLPMPSSYVPGVTSRLTDKMTFRQRLENWLLYTVSDMIYSYYIFPEWDEYYSKVLGKPTTLCEIMGKADMWLFRSYWDFEFPQPYLPNTEFVGGLHCKPAKPLPKEFEEFVQSSGKDGVVVFTLGSMIKNLSEEKSNMIASALAQIPQKVLWRYTGKKPKTLGANTRLYKWIPQNDLLGHPKTRAFITHCGTNGIYEAIYHGVPMVGIPMFGDQHDNLARMKAKGAAVEVDLQRMTSADLLNALKAVINNTSYKENAMKLSRIHHDQPVKPLDRAVFWVEFVMRHKGAKHLRPASHDLNWFQYHSLDVIGFLLACVATVAFLVTKCCLFCCWKFGKTAKKKKRE

SEQ ID NO: 8445 - protein, 518 aa, Drosophila virilis
MRLLTLLLVALITLIGRALQTEGSKILAIFAFPGRSQYIFAESYLKALAARGHEVTVINTFDNEAASNVRFITASKIHDYYEDMLNAMIAPSFWQKHKTFSWMLEVIAECVLADENVQQLLKSGETFDLVIAEVVHTESLFGFAQHFNATLMGFSTYGNDYFIDELMGNISPQAYNPLISSPRSNPMTFYERLENHWEIWLEKLVQSFIHYPKMEQQYAKYFPQAKKSLSETLDSFALMLLGQHFTLSYARPYLPNMIEVGGLHIAQKQKALPEDIKHFIETSPEGVIYFSLGSNVKSKDLPVETRNMLMMVFGGLKQRVLWKFEDDQLPNKPDNVFISKWFPQPDILAHPNVKLFITHGGLLSTIESIYFGKPVLGLPVFYDQFMNVKHAARMGFGLGLDLLNLKQTELVDTINILLTTPTYSKTASILSERYRDQPESAMDRAIWWTEYITRHKDASYMRAPSRDMSYVQLHSLDTLAVLLAAPLLFMWLLITFIRWLLCLIFGDKQRNRDKQKRH

SEQ ID NO: 8446 - protein, 515 aa, Anopheles gambiae
MKLSQGVAIAWVVLCCCFAQLEAYRILCIYPSSGRSHVLVGQALLKGLAARGHDVTMVSPFKLSKPVPNYREIVVQKVDLGQMTRDFLQKNTGNSLGGIVHLFQTQFRTAEMAMEDAQVQALKDEHFDLVIVGYFVADFVLGFGPHFNAPTVVLFSAGLTKMTADFVGNPRAVATVPAIMVGGRGALDFAGRVKNFLFAGVENVITAVSDYVQTSYYEQFFPPGRYPSYADVRRNVSLVLLNTHFSQATPRPYLPNVVEVGGLQIKAKPDPLPEDIREWLDGAGEHGVVYFCLGSNLKSADLPQAKLDAILKTFAQLKQRVLWKWESDHIPNAPPNVLSKAWLPQDDVLAHPNVKLFISHGGLGGMAEAKYHGVPVLGIPIFAEQHQNIQSMIDDGVAMQVDYKQLDERTFSRAVNIMVREHRFAERAKAISELYRDRPQSAMDLACYWVEYVARHRGAPQLHYPGADMNFFQQESLDVIAFLVAILYVVFKVSKLVLRFAYRKVFKSSRKTKVQ

SEQ ID NO: 8447 - protein, 528 aa, Cavia porcellus
MKRILALLLLQLCCHFHSGSCGKVLVWPMEFSHWMNIQVILEELIRRGHEVTVLRPSCFIFVDVNTTSEIKFETFHTSFTRDYWEKIFTDLVTTWLNTGSVDTCLDYFPEVEKLFKHFSDEWENVCKELVSNKKFMKNLQESRFDILLADAVGPCGELVAEILHIPFVYSLRFSPGFQAEKRAGGLLLPPSYVPVIMSGLSGEMTFMERVKNMICMLYFDFWFETFDEKRWDKLYSEILGKPSTLYETMSKADMWLIRSYWDMEFPHPSLPNFDYIGGLHCKPAKPLPKEMEEFVQSSGEHGIVVFSLGSMIRNMTDEKANLIASALGQIPQKVLWRFDGKKPDTLGANTRLYKWIPQNDLLGHPKTRAFITHGGANGIYEAIYHGIPMVGLPLFGEQYDNIAHMKAKGAAMKLEFNSLSSTDLLNALKTVINNPSYKENAMWLSTIHHDQPMKPLDRAVFWIEYVMQHKGAKHLRPLAHNLTWYQYHSLDVIGFLLACVAAITFLIIKCCLFCFQKFMETGKKKKRE

SEQ ID NO: 8448 - protein, 523 aa, Lingula anatina
MRITTTALWCVAVLVVSTQVEDISSSKILLIPYIHQQTSRLMNVVKIGQMLSEHNHDVAMLLPSNCVPKNVPEKIRTITFKLDTLPFEISEETFLHEMRKDPFVFMSSWIEYSKDLLDSLFNDSGVIMKMVNEEFDLVFMDILSPQGLIVRDYLGIPGVGYSNLGFGDDWYYFSPLNPSYVPSTTGKSSDRMDFWERLINTLSIFGTHYVLGKMIEPFSEAKLKYNLNTSLSILEAPTRLSLVIVNVDFVFDYPRPVMPWVKPVSGLLFHPAKPLPEDLERFVQSSGEHGIIIMSFGTMIAGLSSETMAMIARVFARLPQKVILRNSKFNVQRLGNNTKMLSWIPQNDLLGHDKTRLFITHCGVSSSHEALFHGVPVIAVPLFFDQFSHAKKLVQRIGMGEELDFYNLTEQAFGATIKSVLTNPSYYENAKRASALVRDQPMNGKDTMRFWIEYVIRNKEAMHFHSQAMERLNWFQYLLLDVIGFIIIITFCVLIVIWILSKVLYSLVPKMYRRKPDVKTKGE

SEQ ID NO: 8449 - protein, 403 aa, Branchiostoma floridae
MLGRLKTAQYSVVISDPFLRCGTIVAANLGIPHIANSADDGTFFDKMATGVPLPLAYVPSIELGYTDQMTFLQRLENTCFFGLSNIFKSWLYANVYHDLVHTYVSEKETIQSLTSHTDLWLYHTDTVLGFPRPSMPNMVQVGGLMADRPVVPLSVDIEDFMQSSGDDGIIVVSFGSMVHTMSTERKEMFAAVFAQLRQKVVWRYLGEKPAGLGNNTKLMSWLPQKDLLAHPKTRAFVNHAGRNGVYEALYHGVPMVCLPLFGDQPGNSARVVARGLGVSLDFRTVTSDQFHQAVLRVLTISSYRETAARLSRLYRDQPQSPMDRAVWWIEHVIKHGGLPHLRARAVELPWYQYYLLDVAAFLLAICSAVLGTLWYSCSSVCRKVCCKRGGKLRSRRKATIIYV

SEQ ID NO: 8450 - protein, 445 aa, Carlito syrichta
MSMKWVSVPLLIQLSCYFSSGSCGKVLVWPTEYSHWLNMKTILDELVQRGHEVTVLASSISILVDPNKSSTIKFEVYPTSLTKNDYKNTITRVINLWTHAPKDTFWSFFSQVQEIMWDFSNVFKKLCEDTVLNKKLMRKLQEARFDVLLADTIGPGGRPTTLLETMGKAEMWPIRTYWDFEYPRPLLPNFDFVGGLHCKPAKALSKEMEDFVQSSGENGIVVFSLGSMVSDMTEERVNVIASALAQIPQKVLWRFNGKKPDTLGPNTRLYKWIPQNDLLGHPKTKAFITHGGTNGIYEAIYHGIPMVGLPLFADQPDNMAHMKTKGVAISLDYHTMSSTDLLNAVKTVIHNPLYKENAMKLSEIQHDQPMKPLDRAAFWIEFVMRHKGAKHLRVAAHDLNWFQYYSLDVIGFLLACVATVIFTVTKCCLFFFQKFAKTERKGKKD

SEQ ID NO: 8451 - protein, 274 aa, Ochotona princeps
MWLIRSYWDLEFPRPTLPNVHFVGGLHCKPAKPLPKDMEDFVQSSGEEGVVVFSLGSMVSNMTEERANVIASALAQLPQKVLWRFDGKKPETLGPNTQIYKWIPQNDLLGHPKTRAFVTHGGANGIYEAIYHGVPMVGLPLFADQPDNIAHMTAKGAAVRLNWKTMSSADLLNALRTVIHDPSYKENVMMLSRIHHDQPMKPLDRAAFWIEHVMRHKGAKHLRVAAHDLTWYQYHSLDVIGFLLACVTITTYLVIKICLSVYQKLVKTEKKKSD

SEQ ID NO: 8452 - protein, 542 aa, Drosophila mojavensis
MGRSLLSGTFVCLLLGFFVLQSARVEGANILGVFTSHSPSHFIINMSIMKALAEDGHNVTVVSGTPPKVTHKSIKHIVIPLSAAEEKELNDGMSSLAKEKPSVFTTFRNIFGSLSMLIYKQVDVLEDTRFTDLYKNKDNKFDAVIVGFFFNNYQVGLGSLFNCPIILTWTGPPMMQIDRNIGNPELISSVPSMHVAVAPGRAMNFKERLANFGGTMFFRLFAFYLEILNDKFYDRLWGNIPSMMTYEQAKQNISLAFCSSHGISEGPIRPNVPALVEIGGIQIKDKRDPLPEDIQQFLDGAKHGAILFSLGSNLKGDHIDPQIIKKIFKVLAGLKQRVIWKWDDLDKLPGKSANILFKKWMPQDDILAHPNIKLFITHAGKGGVTESQYHGKPMLALPVFADQPGNADKLVESGYGLKLDLLTLEVDEFKDAIKELLSNPTYTNKIQHFSKIYRDRPMSARDSVIYWVNYVLRHHGAAHMQSPLVKMGYIATHNIDLYLLLAAILLVIVLISKAVLRFVWSKCCGGRATKQKSSQKTKVKKH

SEQ ID NO: 8453 - protein, 539 aa, Microtus ochrogaster
MSKVFYFSEMSVKQISVFLLIQLICSFRLGTCGKVLVWPTEYSHWINIKVIVDELVQRGHEVTVLTSSASILIDPNSDSSINFEIYPVPVSKEELQYMFQSWVAEWTRDFQKYSFWTYYSKLEEVFSSYSDVIESFCKALVWNKSLMKKLHESKFDVILADAIGPCGELLAELLKTPLVYSLRFCPGYEIEKYSGGLTLPPSYVPVVLSEFSDHMTFVERVKNMLQVLYFEFWFQTFNEKSWSQFYSEALGRPTTLSEMIGKADFWLIRTYWDLQFPHPFLPNFDFVGGLHCKPAKPLPKEMEDFVQSSGEHGIVVFSLGSMVKNISSEKANIVASALAQIPQKVLWRFDGKKPDTLASNTRLYKWIPQNDLLGHPKTKAFIAHGGTNGIYEAIYHGIPIVGIPLFADQPDNINHMVAKGAAIRVDFSTLSTTKLLTALRTVINDPSYKENAMRLSRIHHDQPVKPLDRAVFWIEFVMRHKEAKHLRPALHDLAWFQYHSLDVIGFLLACVAAVVFIITKCCLFCCHKTGNKGKKKKKE

SEQ ID NO: 8454 - protein, 530 aa, Ctenocephalides felis
MRTVLLYLSLLLLIINGQNAEKPKRQKNILCIMAMASPSHHIWNKAIMQTLASNGHNVTALSIDTDKTSGPNIHYLKINGVYESLYSGDEPFDLLEFSKKSLIGITVDIAKWYLTVCRASLKSEGLQRLLDYPKDFKFDLVIFDYTNLPCLHGFVSRFNSPPQIGITAFANPPHTSDLVGSPNFVSLKPHYTTTMGSTMSFLERLYNSLLYSVELVQRRLLIWWVRNEVREVFGDYELDVGDLEKKVELVMVNSHPGMDVPEPVLPNVIQVGGLQIKEPKALPEDLKRFLESSKKGSVLFSLGTNMKSEIIGEEKIGMFIKAISRFPEYNFLWKIELENRTFPKNLMVRKWLPQNDVLAHPNIKLFITHGGLLSSQESTWHGVPIIGMPFLVDQHTNVQKSVDAGVGEKLDFFQLTEEIVYQKIKMILENTSYRQKMALRSSRFRDRPMHPLQEATWWCEYVLRHKGAPHLKSLAAAMEAPALFMWDLMLVWLGMFLGVAFLVVLILKKIFRRKEITNIRRKEFEEKKIR

SEQ ID NO: 8455 - protein, 542 aa, Trichuris suis
MAKAAAMLWLATVVLLSHLVAAGRVLFVPSSVYASHKTIMYHLAEELVKRGHQVSVWGVFLKPDRVPIPKGVEDISWIVKVPESYIQNMFLYENASVYKAVWKDSVSEPARKAANWAMALRMCEVALETRRADFEKLVHRDFDLIIVDDLFAPCGLLLTGLRKGVFVYWSMTHMRTETAWSNHSPSPPSYIPVPGTALTDSMDFLERSFNFLSYMKTLYIHHRIILRSLDIVFKKFYPDIPDAFYIERNASLNFINTPPLFDFPRPFMPRVVFVGGMHCRKAQPLEKKFEEFAGSASNEKGFVIFSTGFSVKWEKVPDKIVAMFVEAFRALPNKVIWQYDGKPISNLPSNVLVDSWIPQQDLLGHPKCRGLITHGGLNSVVESMWHGVPIVGIPIYSEHRDYIVRATARNAGIMLPKSNLSKEAIVDAVQMLTLDSKYKESAVSFMELLQDVPYTELEHAAFWVEFIFRHQEVPHARSGADDLNLLQYFLVDVIAFLVACLIAFAVVAYYCVKYTCRVCSFCGSLFCRLVHTGKSALKRKVE

SEQ ID NO: 8456 - protein, 536 aa, Tupaia chinensis
MFSIVDITMRKKFVQLLVFNWTLTEIVLSGNVLIWPTDGSHWLNIKSILEELIQRNHNVTVLASSATLFINSTPDSTVNFEEIPVSYKKSHIDSLIEHMIMLWIDHRPTPLTLWTFYKELGKLLETFFRINVQICDGILNNPKLMAKLQKASFDVLVADPVTICGDLVAVKLGIPFVYTLRFSPASTVERHCGQIPAPVAYVPAALSELTDQMTFGERVKNTISYPLQDYIFQSYWGEWDSYYSKVLGRPTTLCEIMGKAEIWLIRTYWDFEFPRPYLPNFEFVGGLHCNHSKPLPKEMEEFVQSSGEDGIVVFSLGSMVKNLTDEKANIIASALAQIPQKVLWRYKGNKPAALGANTRLYDWIPQNDLLGHPKTKAFITHGGTNGIYEAIYHGVPMVGIPMFADQPDNIAHMKAKGAAVDVNMNTMTSADLLNALKTVINEPSYKENAMRLSSIHHDQPVKPLDRAVFWIEFVMRHKGAKHLRVAAHDLTWFQYHSLDVIGFLLACIISAMFLVTKCCLFFYKKFHKTEKKKKRE

SEQ ID NO: 8457 - protein, 414 aa, Loxodonta africana
MSTKWISVLLLIQLSCYFSSGICGKVLVWPVEYSHWMNMKTIVDELTQRGHEVTVLTSSASILIDPSKPSAIKFEVYPASLTKDDFEFLFMKLIRKWTYDMPKDTFWTHFSAYNEKKWNQFYSKVLGRPTTLFETMGKAEIWLVRNYWDFQFPRPFLPHFHFVGGLHCKPANPLPKEIEEFVQSSGKHGVVVFTLGSMVSNLTEERAHVIASALAQIPQKVLWRFDGKKPDTLGPNTRLYTWIPQNDLLGHPKTKAFITHGGANGIYEAIYHGIPMVGIPLFADQPDNIAHMKVKGAAVSLDMDTMTSTDLLNALKTVIYDPSYKENAMRLSAIHHDQPVKPLDQAAFWIEFVMRHKGAKHLRPAALSLTWYQYHSLDVIGFLLACVAIVSFLVIKCCLLGYQKFFKAGKKKKR

SEQ ID NO: 8458 - protein, 460 aa, Cavia porcellus
MSLHITPCQMSRKTDNGFTFTAKLLVNLSQNPWFMEEISSAKRNRMIQNISSLQITSVRSIKSGKQCKILQDSINQKRINSDPVAPCGELVAELLKLPFVYSLRFSPGFQLEKSAGGLPFPPSYIPVLMSRLSGEMTFMERVKNMICMLYFDFWIEVFNQKNWNKLYSETLGKPTTFYEQMQKADMWLIRSYWDLEFPRPTLPNFEFVGGLHCKPAKPLPKEMENFVQSSGDHGIVVFSLGSMVSDMSEATANAIASALGQIPQKVIWRFDGKKPDTLGANTQLLKWIPQNDLLGHSKTRAFITHGGANGVYEAIYHGIPMVGIPLFAEQHDNIVYMEAKGAAIKLDFHTISTTDLLNALKKVINNPSYKHNAMRLSSIQRDQPMRPLDRAVFWIEFVMRHKGAKHLRPLAQNLTWYQYHSLDVIGFLLACAAIITFVPIKCCLFCFQKFVKTGKKKKRE

SEQ ID NO: 8459 - protein, 530 aa, Orycteropus afer
MSAKWISVLLLIQLSCYFDSVTCGKVLVWPTEYSHWINIKTILDELIQRGHEVTVLTSSASILIDPNKSSDIKFEVYPTSLTTPDLEILFMKWIKKMTYNMPKDTFWAYFSRLQEIFWEYSDCIERLCKDVVFNKELMIKLEESRFDVVLADAIGPCGELVAQLLKIPFLYTLRFSPGYTLEKLSGGLLTPPSYVPIVLLELYDRMTFVERIKNMIYMLYFDFWFQIFNMKKWDQFYSDVLGKDTTLIETMGKAEIWLIRTYWDFEFPRPFLPHFEFVGGLHCKPANPLPKEFEEFVQSSGKHGVVVFTLGSMVRNVTEERANTIASALAQVPQKVLWRFDGKKPDNLGPNTRLYKWLPQNDLLGHPKTKAFITHGGTNGIYEAIYHGIPMVGIPLFADQPDNIAHMKAKGAAVSLDIKTMTSADLLNALNSVINESSYKENAMKLSAIHHDQPVKPLDRAVFWVEFVMRNKGAKHLRPASLSLTWAQYHSLDVLGFLLACVAIVTFLVIKCCSFGYQKFFKTEKKEKKD

SEQ ID NO: 8460 - protein, 529 aa, Galeopterus variegatus
MSMKWNSVLLLLQLSCYFSSGSCGKVLVWPTEYSHWMNMKTILDELGQRGHEVTVLTSSASIHVDPNKTSTIKFEVYPTSLSRDAFDAFVLMVVKKWERIPKDRIWLHLSEMQEIMWDFSDCMRNMCKDAVLNTKLMRKLKESKFDVVFADAIGPCGELLAEILKIPFVYSLRFSPGYSLEMHSGGLLFPPSYVPIILSELHNQMTFMERIKNMIFALYFNFWFQTFNLKEWDQFYSEVLGRPTVLLETMAKAEIWLIRSYWDFDFPRPLLPNFDFVGGFHCKPAKPLPKEMEDFAQSSGEHGVVVFTLGSMISNMPEERANVFASALAQIPQKVIWRFDGKKPDTLGANTRLYKWIPQNDLLGHPKTKAFITHGGGNGVYEAIYHGVPMVGMPLFADQPDNIARMMAKGAAVRLDFDTVSSTDMLNALKTVINDPLYKENIMRLSRINHDQPTKPLDRIVFWIEFVMRHRGAKHLRVAAHDLNWVQYHSLDVIGFLLACVATVIFAITKCCLLCCQKFAKTGKKEKRE

SEQ ID NO: 8461 - protein, 445 aa, Condylura cristata
MSVKWMSALLLLQLGCYFSSGSCGKVLVWPTEYSHWMNIKTILDELVARGHQVVVLTSSASILIDPSKPSAIKFEVYPTSFSKAEFESAFKQVVSEWTYELPKDSFWSYFSKSQDILWRFFDIVNQLCKDVVKNKKLMTKLQESRFDLILSDPVGPCGRPTTLAETMGKAEMWLIRTYWDFEFPRPFLPNFEFVGGLHCKPAKPLPKEMEEFAQSSGENGIVVFTLGSMVSNMPEERANVIASALAQIPQKVLWRFDGKKPATLGANTRIYKWIPQNDLLGHPKTKAFITHGGTNGIYEAIYHGVPMVGVPLFADQPDNMVHMMAKGAAVRVDFHTMSSTDLLNALKTVINDPSYKENIMKLSRIQRDQPMKPLDRAIFWIEFVMRNKGAKHLRPASHDLTWAQLHSLDVIGFLLACVVTAVYVIIRCFLFCCRKVVKSGKDKRE

SEQ ID NO: 8462 - protein, 474 aa, Branchiostoma floridae
MVPLPVFNSHWMVAASIGQALVNKGHVVTVVVEEDIVEKRRAERPDFTFETFQDDGFGSRLRQFQDDVFRMAESMSASEEFIQHTNAADWAKKHCEHLLGGDNGDLLRRLKTAQYSVVISDPFLRCGTILAANLGIPHVATDPGNNLDDGWFISQMQRLENAYLDVLRNWLYAYIYNDLVRNYVSETDTIHSLTSHTDLWLHQTDTVLNFPRPSMPNIVQVGGLTVRAGIPLSEDLEDFMQSSGDDGVIVVSFGTMVHTMSTERKEMFAAVFAQLRQKVVWRYTGEKPAGLGSSTKLMSWLPQNDLLAHPKTRIFVNHAGLNGVYEALYHGVPMVCLPLFAEQPGNAARVVARGLGVSLDFRTVTSDQLYQALLQVLTNNSYRETAARLSRLHRDQPQSPMERAVWWIEHVIKHGGLPHLRTRAVELPWYQYYLLDVAAFLLGICSAVLGTLWYSCSFVCRKVCCKRDGKLKSQ

SEQ ID NO: 8463 - protein, 529 aa, Cyprinodon variegatus
MKLCLSALVLLLLCAAKISNGGRILVWYTEASHWINMKPVLETLVDRGHQVTVLVPSASMFMNSSEPSRFQYEPFDVAITVKDLEKRLEAVLHFSMHEINVINPVMIPFRFFALMKDNMDVSFKLLDGVVKSETMMKKLKEGNYDLLFADPIYPGSDLTAHILGIPLVFSLRFSIAHNVERHCAQLPAPPSYVPAAMSSLTDKMDFPQRMGNVLFYALQDFLLEQFMWKEFDKYYSEVRGTPTSACKMMGNADFWLLRTYWDFDFPRPSLPNIKFVGGIHCKPAKPLPKEMEEFVQSSGDAGIVVFSLGTVVKNLTTDKANMIASALAQIPQKVLWRYSGEKPQTLGPNTRLYDWIPQNDLLGHPKTRAFVTHGGTNGIYEAIYHGVPMVGIPIFGDQPENMVHVETKGAAVTVNLNSLNADELRDAVNTVINNKSYKENVMRLSRINHDRPMSPRDEAVFWIEFTMRNKGAKHLRVQSHDLTWYQYHSLDVITFFIILDLLLLIILLKTCSFCFKRCCGRKTTKRKAE

SEQ ID NO: 8464 - protein, 525 aa, Polistes canadensis
MRILVSFCLAFIISQSSLIDGYRILGLFPLAGKSHWVMMEALMVGLAERGHQVDVLTQFKIKNPHPNYNEILLKNEVGSPVNNVTAHDTKRFSSLNMEHLTYIAGYKICMLMEQPPIKSIITNPPKDPPYDLVIIELFAAHCYLAFGRHLKVPIVGVMSSPFHDWSSHWIGVPNEGAYVPNIFSGFSQKMSFVERLTNTFMIHFLQLQIDYHVNKQNEITKQYFGIDATTSDLFQDLSLVLVNSHHSLHGIRSFPHSVIEVGGLHLSNNNTDPLQPEVQKWLDDSKDGCIYFTFGSMVRIETFPKEMIEMFYKSFEKIAPTRVLMKVAKKEELLPGLPKNVMTQSWFSQIPVLKHKNTRAFITHGGLMGTTESIFYGIPMIGIPLFGDQSVNIQNYVNRKVAISLGSIYELTEEKLTNALKTILNDPSYMTNIKKLSETFKDRPEPVMNKATYWVEYVIKHKNLLQSPAIFLPWWQRYLFDVYGTIILVLILVTLLVIYLIKLIVKFVFGKNRQKVEKNLKKKKN

SEQ ID NO: 8465 - protein, 529 aa, Vicugna pacos
MKTVKGFCVLFMLHLGFFDSGRAGKVLVWPMDFSHWINLNVILEELHRRGHEITVLVPSPSLLLDHTKIPFNVEILQLPVTKETLREELDTVLYSASFELSNLSWWEMNIKLIKIGQNFFRTIKRVCDSAITNKDLLSRLQAAKFDICLADPLALDGELVAELLNIPFIYSFRFSYGNVIERWCAGLPMPSSYIPGSTSRLTDNMTFVQRLENWLLYTLIDMLYSYYIFPEWDAYYSKVLGKPTTLCETMGKAEMWLIRTYWDFEFPQPYLPNVEFVGGLHCKPAKPLPKELEEFVQSSGEDGVVVFTLGSMIRNLTEEKANMVASALAQIPQKVLWRYTGKKPDTLGANTRLYEWIPQNDLLGHPQTRAFITHSGTNGIYEAIYHGVPVVGMPMFGDQHDNVARVKAKGAAVEVDLPTMTSSDLLRALKEVINNPSYKENAMKLSRIHHDQPVKPLDRAVFWIEFVMRHKGAKHLRPALHDLTWYQNHCLDVIGFLLACVATAVFVITKCCLFCCLKFGKTTKKKKRE

SEQ ID NO: 8466 - protein, 529 aa, Saimiri boliviensis
MSVKWTSVLRLIQLSFYLGSGYCGNVLVWAPDYSHWMNMKTVLNELVQRGHEVTVLAKSSSIVFDPNNPSTLKLEVFPTSLTKTELENIVMQQVKRWSDFPKDSFWSYFSQVQEIMWIFSEISRNVCKDLVSNKKFMKKLQKSRFDVIFADAMFPCGELLAEIFNIPFVYSFSSSTGYVLEKYGGGFLFPPSYVPVVISELSDQMTFMERLKNMIYMLYFDFWFQVFDMKKWDQFYSEVLGRPTTLFETMEKADIWLIRKSWNFQFPHPLLPNIEYVGGLHCKPANPLPKELEEFVQSSGENGIVVFSLGSMVSTMTEERANVIASALAKIPQKVLWRFDGNKPDALGPNTRLYKWIPQNDLLGHPKTRAFITHGGANGIYEAIYHGIPMVGIPLFADQPDNIAHVVAKGAAIRVDFNTMSSTDLLNALKTVINDPVYKENIMKLSKIQHDQPVKPLDRAVFWIEFVMRHKGAKHLRVAAHDLTWFQYHSLDVIGFLLACAATVIFIITKCCLFCFWKFARTGKKGKKD

SEQ ID NO: 8467 - protein, 528 aa, Equus asinus
MSLKWISLLLLLQLSCYFSPGSAGKVLVWPTEYSHWINMKKILDELVQRGHEVTVLTASASILVDPNKPSDIKFEIYPASSTRQEFEDIVRKIINDWTYLTKEPFWTQFSRLQEVLQEFSDYFEKLCKDAVLNKKLIRKLQESKFDLILADAVGPCGELFAELLKIPFMYSLRFVPGHKVEKYSGGLPFPPSYVPAVMSELSDQMTFMERVKNMLYVLYFDFWLQTFNEKQWNQFYSEVLGRPTTLFELMRKAEMWLVRNYWDFEFPRPFLPHFQFIGGYHCKPAKPLPKELEEFAQSSGENGIVVFSLGSMISNMTEERANVIASALAQIPQKVIWRFDGKKPDTLGPNTRLYEWIPQNDLLGHPKTKAFITHGGANGIYEAIYHGIPMVGIPLFADQPDNVVHVKTKGAAVRLDFTTMSSTDLLHALKRVINDPSYKENAMKLSRIQHDQPMKPLDRAVFWIEFVMRHKGAKHLRPASHDLNWFQYHSLDVIGFLLACVATPVFVISKCLVYCWKFAKRGKKEKRE

SEQ ID NO: 8468 - protein, 531 aa, Oryctolagus cuniculus
MSRTCVSLLLLLLQLSCCFSSGSCGKVLVWPMEYSHWMNMKTILDALVQRGHAVTVLRSSASILIDSKNESGIHFETFHTSYTKDEIEGILLNGINILTYDVSRDAYWEYFPLMQKLFYEYSDVYKSICKDLVLNKKIMAKLQESRFDVVLADPFVPCGELLAELLNRPLVYSLRFTPGYTYEKYSGGLLFPPSYVPVIMSDLSGQMTFMERVKNMLFILYFDFWFQMLNAERWDQFCSEVLGRPVTFSELMGKAEIWLIRSYWDLEFPRPLLPNVYFVGGLHCKPAQPLPKEMEAFVQSSGEEGVVVFSLGSMVSNMTEERTNVIATALAQLPQKVIWKFDGKKPDTLGANTRLYQWIPQNDLLGHPKTKAFVTHGGANGIYEAIHHGIPMVGLPLFGEQHDNLAHMKAKGAAIRLDWKTMSSADLIDAVKTVINDPTYKENVMKLSRIHHDQPMKPLDRAVFWIEFVMRHKGAKHLRVAAHDLTWYQYHSLDVIGFLLACVTITTYIVIKFCLLVYQKLFMTGKRKKQD

SEQ ID NO: 8469 - protein, 541 aa, Gekko japonicus
MKSYIPVFILLWNAVGIARTAKIVVVPTVMFESHLYIFKTVASALHEQGHQTVFLLSEGRKIPPSNHYRLLHYPGLFNSTTSDEFLQSKMRNIFSGRHTILELFDILDHYTKNCDMIVGNKKLLQTMKQEKFDLLLVDPNEMCGFVIAHLLRVKYAVFSTGLWYPAEVGAPAPLAYVPEFNSLLTDHMNLLERIKNTLVYLVSRFGVSFLVLPKYERIMQKYNVQPERSMYELVHGSSLWMLCTDVALEFPRPTLPNVVYVGGILTKPASPLPEDLQTWVDGANENGFVLVSFGAGVKYLSEDIAHKLAHALARLPQRVIWRFSGNKPRNLGNNTKLLEWLPQNDLLGHSNIKAFLSHGGLNSIFETMYHGIPVVGIPLFGDHYDTMTRVQSKGMGILLNWKTITEDELYDALVEVINNPSYRQQAQKLSEIHKDQPGHPVERTVYWINYILRHNGAQHLRAAVYTISLYQYFLLDIAFVVLLGAALLCYVLSRIAKFVRKQSKHLWSADEHTAINGHYQNGIPNGKYRRNGHIKHEKKVK

SEQ ID NO: 8470 - protein, 556 aa, Oreochromis niloticus
MERWNRTMLLPSSLLLLLGLLTWSPSTTRAAKVIVVPPIMFESHLYIFKTLATALHKEGHETHFLVSEGREVPPSPHYHLQRYQGIFNSTTADNFLQSKVTNIFSGRLTFLELFDILDHYSQNCDAVVGNTEVMNRLKEAKFDLLLVDPNEMCGFVIAHILGVQYAVFSTGLWYPAEVGAPAPLSYVPEFNSLLTDRMSLMQRIANTAVYLVQRFGVHYIALPKYDRIMKKHGVKPQVAMADLVQGSRLWMLCTDMALEFPRPTLPHVVYIGGILTKPPSPLPQDFEDWVKDTEEHGFVVVSFGAGVKYLSSDIAHKLAGALARLPQRVIWRFSGVPPSNLGNNTKLVDWMPQNDLLGHTNTRAFLSHGGLNSIYEAMYHGVPVVGVPLFGDHYDTMTRVAAKGMGIMLHWKYMTEEDLFTALSSVITDTRYRQQARYLSNIHKDQPGHPVSRAVYWIGYILRHNGANHLRSAVYEVSLYQYFLLDVVITVGAAMALAVFAVRRLARLLRGKSRDHSKGDNVRDDGSMANGHCHNENMANGKHKRNGSLKNEKKIN

SEQ ID NO: 8471 - protein, 529 aa, Condylura cristata
MSVKWTSALLLLQLGCYFSAGGCGKMLVWPTEYSHWMNMKTILDELVARGHQVVVLASSASILIDHSKPSAFKFEVFPTSLSKADFEIAFKQLVSEWTYELPKDSFWSHFSKMQEASWKFVVISRRLCEDVVKNTKLVTKLRESRFDLVLADPVGHCGELLAEVLKVPFVYTLRFSLGYQFETLGGKLPVPPSYTPVVLSELSDKMTFMERVKNMIYVLYFNFWFQSVNFKEWNEFYSEVLGRPTTLTETMGKAEMWLIRTYWDFEFPRPFLPNFVFVGGLHCKPAKPLPKEMEEFVQSSGENGIVVFSLGSIVSNMPEERASVIASALAQIPQKVLWRFDGKRPATLGANTRLYKWIPQNDLLGHPKTKAFITHGGTNGIYEAIYHGVPMVGVPLFADQPDNIAHMMAKGAAVRVDFQQMSSTDLLNALKKVINDPSYKENVMKLSRIQRDQPMKPLDRAVFWIEFVMRNKGAKHLRPASHDLTWAQLHSLDVIGFLLACVVTAVYVIIRCFLFCCRKVVKSGKDKRE

SEQ ID NO: 8472 - protein, 530 aa, Heterocephalus glaber
MFMKWISSLLLLQMSCYFNSGSCGKVLVWPTEYSHWMNMKNILEELIQRRHEVTVLRPSNYIFVDVNSSSGIKFETFTASINRDEWEKYFIQLVTRWINIGPIDSCIPYFSELENMFKEFFDTWQHLCKEIVSNKILMKKLQESRFDVLLSDPISPCGELVAELLKIPFVYTLRFSPGFQLEKFAGGLTLPPSYVPVVMSRLSGQMTFMERVKNMICMLYFDFWFDTFNEKKWNQLYSEVLGKPTTLYKTMAKAEMWLIRSYWDLEFPHPTLPNFDFVGGLHCKPAKPLPNEMEEFVQSSGEHGVVVFSLGSMVSNMTKERANMIASALAQIPQKVLWRFDGKKPDILGPNTRLYEWLPQNDLLGHPKTRAFVTHGGANGIYEAIYHGIPMVGIPLFGEQHDNIAHMMAKGVAVKVEFITLSSTELLNALETVLNNLTYKENAMWLSTIHHDQPMKPLDRAVFWIEFVMHHKGAKHLRPLAQNLTWYQYHSLDVIGFLLSCVATITFLAIKCCLFCSQKFVKKGKKQKRE

SEQ ID NO: 8473 - protein, 514 aa, Halyomorpha halys
MMKASSMPAQLLLFLFFGFELCSASNILVISTVASPSHSIWCNKLAQLLVNRGHMVTVLDADPPRKKVANLTTYTLEGGYEYAEEIDYVKISSEHSPKGAIDFFYSASLTSCRNMLLSPTFKRFLNEHSSNKKPFDMIIHDATNCECFLGLVPYFGNPKLVLVTAYGESQALYVMGSQGHMIHSPFQVTAFSHPMSFVEKLQNMFYSLYNYYEYHKLVNSLDGYTKEVFGQSTPHVLEIAKSAAVALVNAHPILDGAKYYSPAIIHVPGFHIDEPKKLDVETQEFLDGAKHGAIYFSLDTNLKSSLMSEDKINVFLNVFKNLKQRVLWKFEAPSIKNLPENVKISKWFSQNDVLAHPNMKLFITHCGLLSTQEAIYHGVPIISIPFWMDQHSLTDKLLRKGVAIPLSYGGISYNLLQQAIQEILTNDSYTKEMKRWSKLFTDQPMKPKELAVFWIEHVLRNDNHKYLQPPEAFLRTLELIFFDLKTILGICLGLFIAFLASFLKRKEQRKLKKH

SEQ ID NO: 8474 - protein, 238 aa, Galeopterus variegatus
MEDFVQSSGENGVVVVSLGSMVPNITEDRANVIASALAQIPQKVLWRFEGKKPRTLGPNTRLYKWIPQNDLLGHPNTKAFITHGGANGIYEAISHGIPMVGIPLFGEQADNVAHMKAKGAAVRMDFRIMSTTDLLNALKTVINDPSYKENVMKLSRIHHDQPMRPLDRAVFWVEFVMRHKGAKHLRVAAHNLNWIQYHSLDVIGFLLACVTTAIFLITKCCLFFYRKFAKTGKKNKRE

SEQ ID NO: 8475 - protein, 530 aa, Miniopterus natalensis
MLPQKWASVVLLLQLCSAGCGFCGKVLVWPVDMSHWLNIKNILEELAKKGHEVTVLTPAHTKLIDYKKPSPLNFEILHSEYQKESVEKAHEKFLDVILNVLPNLTPWQSTIKLNDVFLEITESVKTLCESAVYNQALMKKLQERNYDVMVIDPVMPCGELVAELLGVPFVLTLRVSMGGMKEKHCGKLPAPPSYVPVQMVGLTDRMTFLERVKNVMFSVLFDFRIRDYDIHFWDQFYSEALGRPTTLCETLGKAEIWLIRTYWDFEFPRPYLPNFEFVGGLHCKPAKPLPKEIEEFVQSSGKDGIVVFSLGSVIQNLTEEKGNLIASALAQIPQKVLWRYKGKKPATLGANTRLYDWLPQNDLLGHPKTKAFITHGGINGIYEAIYHGVPMVGVPMFADQPDNIAHMKAKGAAVEVNLYTMTSADLLHALRTVINNSSYKENAMKLSRIHHDQPMRPLDRAVFWIEFVMRHKGAKHLRPASHDLTWFQYHSLDVIGFLLACAASAIFLITKCCLFSCQKFGKTGKKKKRE

SEQ ID NO: 8476 - protein, 526 aa, Apteryx mantelli
MAGKEVAVLWLLAVLGCGSGGKVLVWPADNSHWLNMDYILQQLVARGHEVTVLLPSCFLILDPSQPSPFQFEVVEVPISKKEMATLLEEAFYFWIYEQNELPIWEAFYKMGQLMIKMRSTNKIICNEVLTNKVLLERLRASAFDVFLSDPLMPGGELFAEKLGIPFVYTFRFSIGNTVERLCGGLPAPPSYVPAILSRQTDSLSFMERLQNIIFYAAMDILYHHALWGEWDQYYSDVLGRPTTLCETMGKAEMWLIRTYWDFEFPRPFLPNFEFVGGLHCQPAKPLPKEMEEFVQSSGEHGIVVFSLGSMVYNLTDEKSNIIAGALSQLPQKVLWRYKGRKPETLGSNTRIYDWIPQNDLLGHPLTKAFITHGGTNGIYEAIYHGVPLVGIPMFADQHDNIAHMRAKGAAVELDFGTLKTHDLVDAVNTVINNSTYKENALRLSRIHHDQPMKPLDRAVFWIEFVMRHKGAKHLRPASHHLTWYQYHCLDVLAFLFTCAAIAVFILVKCCLFCCNKCGRITKKKKE

SEQ ID NO: 8477 - protein, 577 aa, Fukomys damarensis
MSMAWISALLLLQLSCYFNSGSCGKVLVWPMEYSHWMSMKNIIEELIQRGHEVTVLRPSSFIFVDVNSSSGIKFETFPSSVSREQLEEFYSQLLTKLINIGSIDSCLFCFLNSDDFSKAFSDNVHFFCKEAVSNKKLMTKLHESRFDVLLADPIAPCGELLAELLKIPFVYSLRFSPGFQVEKHGGGLIVPPSYVPTMLLGLGGQMSFIERVKNMIGMLLFEGWFEIFNEKNWNQFYSETLGKRTTLYETMAKAEMWLIRSYWDLEFPRPSLPNFDFVGGLHCKPATSALRTTLYETMAKAEMWLIRSYWDLEFPRPSLPNFDFVGGLHCKPAKPLPKEMEDFVQSSGEHGVVVFSLGSMISSMTEERANAIASALAQIPQKVLWRFDGNKPDTLGPNTQLYKWLPQNDLLGHPKTRAFVTHGGANGVYEAIYHGIPMVGIPLFGEQYDNIANMVAKGAAVKVNFITITSTELLNALKTVLNSPFYKENAMWLSTIHHDQPMKPLDRAAFWIEFVMRHKGAKHLRPLAQNLTWYQYHSLDVIGFLLAGVVIITFLVIKCCLICSRNFVKMVKKQKRE

SEQ ID NO: 8478 - protein, 455 aa, Fukomys damarensis
  MOD_RES (210)..(210): Any amino acid
MSMTWISALLLLQLSCYFNSGSCGKVLVWPMDFSHWLNIKIILEELIQGGHEMTVLRPSSIIFADVNSSSQIKFETFPTSVNEDQWKETSTQLITKWMNMGSIEFFFTQCLEAENIFKDFFDSWRNFCKEAVSNKILMRKLQESRFDVLLADAVGPCGELVAELLKIPFVYSIRGTPGFHVERNGGGLICPPSYVPVLMSGLAGQMSFIXRVKNIMHMLYFDFCFAILNEKEWNELYSEVLGKRTTLYETMGKAEMWLIRSYWDLEFPRPSLPNFDFVGGLHCKPAKPLPKEMEDFVHSSAEHGIVVFALGSMVSNMTEERANTIASALAQIPQKVLWRFDGKKPDTLGPNTRLYKWLPQNDLLGHPKTRAFVTHGGANGVYEAIYHGIPMVGIPLFADQHDNIAHMKAKGAAVKVEFLTMSSTELLNALKTVLNSPSYKENAMWLSTIHHDQPM

SEQ ID NO: 8479 - protein, 529 aa, Colobus angolensis
MSVKWTSVILLIQLSFYFSSGSCGKVLVWAAEYSHWMNMKTILEELVQRGHEVTVLASSASILFDPNNSSNLKIEVYPTSLTKTEFENIITQEIKRWSDLPKDSFWLHFSQMQEIMWRFGDISIKFCKDMVSNKKLVKKLQESRFDVVFADPIFPGSELLAELFKIPLVYSLRFTPGYVFEKHCGGFIFPPSYVPVVMSELSDQMTFIERVKNMIYMLYFDFFFQLYDLKKWNQFYSEVLGRPTTLSETMGKADIWLIRNSWNFQFPHPLLPNVDFVGGLLCKPAKPLPKEMEEFVQSSGENGVVVFSLGSMVTNMKEERANVIASALAQIPQKVLWRFDGNKPDTLGLNTRLYKWIPQNDLLGHPKTRAFITHGGANGIYEAIYHGVPMVGIPLFADQPDNIAHMKARGAAVQLDFDTMSSTDLANALKTVINDPLYKENVMKLSRIQHDQPVKPLDRAVFWIEFVMRHKGAKHLRPAAHDLTWFQYHSLDVIGFLLACVATVTFIIVKCCLFCFWNFAGKGKKGKSD

SEQ ID NO: 8480 - protein, 529 aa, Apteryx mantelli
MMGQRFLWLLWAYTCCWSPGFCGKVVVWPTDASHWINLKVLLEELVLRGHEVTVLVPSINMLIDYRDTSSPFTFEVLQVPFTQETLDTIMEDFLNTWVNEFTNLSSWEVLWKMKKDLEVFANMSKMTCDTLVLNPQLMAKLQQAKFDILIADPLYIGGELVAEILAIPFIYSFRFSIANTAERLCGRLPSPPSYVPASMGRLMDRMHFMERLRNFLFYLYTDYFYLEFWRDKWDEYYSDVLGRPTTLCETMGKAEMWLIRTYWDFEFPRPFLPNFEFVGGLHCQPAKPLPKEMEEFVQSSGEHGIVVFSLGSMVYNLTDEKSNIIAGALSQLPQKVLWRYKGRKPETLGSNTRIYDWIPQNDLLGHPLTKAFITHGGTNGIYEAIYHGVPLVGIPMFADQHDNIAHMRAKGAAVELDFGTLKTHDLVDAVNTVINNSTYKENALRLSRIHHDQPMKPLDRAVFWIEFVMRHKGAKHLRPASHHLTWYQYHCLDVLAFLFTCAAIAVFILVKCCLFCCNKCGRITKKKKE

SEQ ID NO: 8481 - protein, 445 aa, Chrysochloris asiatica
MSVKWVPLLLVIQLSCYFSSGRCGKVLVWPTEYSHWINIKTILDELIQRGHEVTVLTSAASVLINPNMASAIKFEVYPTSFNKEEIEISFMSWINEWTRKSKESPWKHFPEIQKIFWEYSDYLERLCKDVVYNKKLMMKLQESRFDVILADAVGPCGKPTTLSETMGKAEIWLIRTYWDFDFPRPFLPHFDFVGGLHCKPARPLPKEMEEFVQSSGKHGIVVFTLGSMVRNITEEKARMIASALAQIPQKVLWRFDGKKPDTLGSNTRLYKWLPQNDLLGHPKTKAFITHGGTNGIYEAIYHGIPLVGIPLFADQPDNIAHMKTKGAAVSLNIDTMTSTDLLNALKTVINDPFYKENAMRLSAIHHDQPVKPLDRAVFWIEFIMRHKGAKHLRPASHDLTWYQYYSLDVIGFLLACVAIVTFVIIKCCLFSYKKLFKRGKKKKRE

SEQ ID NO: 8482 - protein, 279 aa, Myotis davidii
MKKAEMWLIRTYWDFEFPRPLLPHFQFVGGLHCKPAKPLPKEMEEFVQSSGENGIVVFSLGSMVTNMTEERANVIASALAQVPQKVIWRYDGKKPDTLGPNTRLYKWIPQNDLLGHPKTKAFITHGGINGIYEAIYHGIPMVGLPMFADQPDNIAHMKTKGAAVRLDFNTISSTDLLNALKTVINDPSYKENAMKLSRIHHDQPVKPLDQAVFWIEFVMRHKGAKHLRPATHDLTWFQYHSLDVIGFLLACVATATFVIAKCVLFCCRKFFKTGKSKRE

SEQ ID NO: 8483 - protein, 501 aa, Lingula anatina
MFPFTIVFNSRDVHLERIAARLQNEGHEVTLLVANHYKSTRDLAGVTLLRLPALLKAKDDKEDESLISSPLVKVGKDPITCFRDLLEEDLRLCDVLFKDNHVLQKLKEANYSLLLFDWENLGASAILAQFLAIPSISLSYQGFTEYWLITHQPSFYAYTPHYLSRFSDHMGFWERLENVRMMISDNLLYDEFISRAEVLKLRHFPNSSWPHLRYAHERVSMHLIAHAHFAFDYPRPIMPHVQTIPGLLWNPPKPLSKPFEDIMTSATNGVIIVSFGTGFPTLPKAKAEIFAKVFAKLSQTVIWRYVGPPPRSLGNNTHLVKWIPQNDALAHPTTKLFITHCGVSSTWETLYHAVPVVAMPLLWDQYQNARKLTERAKMGQTVSFLTLTETDLENAIEKVLKDRSYKENAQKMSVLLQDTPWTGYEELSYWINYVIRHNGTLFLHSQPQYLLTWYQYFLIDIIVFVTGLCCLVIVGTFICLVGLWQVLKLLLTFPTRKIKNA

SEQ ID NO: 8484 - protein, 366 aa, Propithecus coquereli
MPGKSTLAILLMLLCCAGCGFCGKVLVWPCDMSHWLNLKCILEELIERGHEVTVLTQHQTILIDYKKTSAMKFEVVYRRSTTSCEILGKAEMWLIRTYWDFDYPQPHLPNFEFVGGLHCKPAKPLPKEMEEFVQSSGEDGVVVFSLGSVVQNLTEKTNNLIASALAQIPQKVLWRFDGKKPDTLGPNTRLYKWLPLNDLLGHPKTKAFITHGGANGIYEAICHGIPMVGIPLFADQPDNIAHMKTKGAAVRVDFNTMSSTDLLNALKTVISHPIYKKSVIKLSRIHHDQPMKPLDRAVFWIEFVMRHKGAEHLRVAAHDLTWFQYHSLDVVGFLLACVATAIFLITKSCLFFCRMFATAGKKEKRE

SEQ ID NO: 8485 - protein, 530 aa, Loxodonta africana
MVPEKWVSALLLLQLCWTGCGNCGKVLVWPSDMSHWLNIKTILEELADRGHEVMVLTPSHIFFVDYYQPSTVNFEVIFMEIGRETVEDLLNDFLELAVNIMPNLSSWQSAKKMQDVFLRSTAYLKHLCENVIYNQTLMKKLKEANYNIMIIDPVVPCGDLIAELLAVPFVHTLRFSMGGTMEKNCAKLPSPPSYVPVPMGRLTDRMTFLERVKNVMFSLLFDFWLQQFDTRFWDQFYSEALGKPTTLCETMGKAEIWLIRTYWDFEFPRPYLPNFEFVGGLHCKPAKPLPKEMEEFVQSSGEHGVVVFSLGSMVTNLTEEKANLIASALAQIPQKVLWRYKGVKPATLGANTQLYDWIPQNDLLGHPKTKAFITHGGTNGIYEAIYHGVPMVGLPMFADQPDNIIHMKAKGAAVDMNMNTMTSADFLNALRTVINDPSYKENVMRLSKIHHDQPLKPLDRAVFWIEFVMRHKGAKHLRPAAHDLTWYQYHSLDVIGFLLACVATVIFLVTKCCLFSFQKFRKAGKKKKRE

SEQ ID NO: 8486 - protein, 484 aa, Myotis lucifugus
MPMKWISVLLLLQLSGHFSPGSCGKVLVWPTEYSHWINMKTIVDALVQRGHEVTVLTSSASILIDPNKPSAIQFEIFPTSLTKDDFEDLFKRLISKWTYTPKDTFWTYFSLLQDNTCEYFDCIQKLCKDAVLNKNLMTKLQESRFDVILADPAGPCGELLAELLKIPFVYSLRFSFGYTIEKYSGGLPFPPSYVPIVFSELSDHMTFMERVKNMIYVLYFDFWFQAFSEKWDQLYREALGRPTTLFELMRKAEIWFIRTYWDFEFPRPLLPHFQFVGGLHCKPAKPLPKVIWRYDGKKPDTLGPNTRLYKWIPQNDLLGHPKTKAFITHGGTNGIYEAIYHGIPMVGLPMFGDQPDNIVRMKTKGAAIRLDFNTMSSADLLNALKTVINDPLYKENTMKLSRIHHDQPMKPLDRTVFWIEFVMRHKGAKHLRPAANDLTWVQYHSLDVIGFLLACVATATFVITKCVLFCCRKFLKTGKKKKRE

SEQ ID NO: 8487 - protein, 436 aa, Acaryochloris sp.
MTHIGILCPTLNGHLNPMMALGHELKRRGHRITIVGLLDGKSKVLAAGLEFLAIGEVKFPFGSTSQSLDKLGQLSGIAAFRYSIELMKQATATLLEEAPAALQNMGVEILLIDQALVGGSSIAQRLDLPFISVACALMFNQDSNVPPFFTSWRYSATWWARLRNQIGYQLLSILAQPSTRQIATYRQQWNLPSLKHQNDFYSPLAQICQQPAEFEYPRQSLPAHFYFTGPYSDQNTREPVDFPFDQLTGQPLIYASLGTLQNRLLGTFEIIAEACQVLNVQLVIALGGGSTPESLPILPGSPLVVGYAPQLELLQRATLTITHAGMNTVLESLSNGVPMVAIPITNDQPGVAARIAWTGAGEVVTLKDLTVSRLRSTIRRVLVMKSYRNNAVRLQKAMQTAGGANQAADVIEQVIATEQAVSVQIQASGSFAMSNR

SEQ ID NO: 8488 - protein, 395 aa, Bacillus massiliogabonensis
MSRIVFFSIPAHGHTNPTLPVVAELVNRGHDVWYYSFLEFKEKIEGLGAKFIPCDEYLPPISQEELERKAGKDFAALIEMIVDTTIALDEKVCAELRDFQPDCIVSDSLCFWGKLFAKKLVIPYICSTTTFAFNRHTAKLMKRSLKEIVSMITGMPRINKKLQLLRSHGYEAENFISIIQNDNETDTIVYTSKKFQPMAETFSGKYAFVGPSIGQYSEKASEDRKGRKFIFISLGTVLNQNKDFYQNCIQAFADSDFDVLMSVGEKTQIDSLGRIPANFKVQNRADQLAILQKADVFITHCGMNSVNESLYYGVPMVLFPLHSEQRAVADRVAELGAGIKLKGNKPKQLEKAVAHVLANRTYLENARVLSEDFRNAGGAARAANVIEVKMNGSEF

SEQ ID NO: 8489 - protein, 398 aa, Ktedonobacter racemifer
MKKYIFLNVPATGHVNPTLPIVQELIQRGEQVIYYLTEEFRAAIEATGAIFRPYESFLEGIGPGPMPLKMAEESRRVLPQVLESIRAEQPDALLYEAMCLWGRIVAQVLQVETIVLRASYAANEHFGLFTARSDASMPFPSELLERFQVSSAELSATYHLPPFDLRQFVAHAEGLNVVFLPRAFQPAGETFDERFVFVGPSLLPRQDAPAFPWERLGDQPVLYISLGTAFNHRPDFFRLCFQAFGELPSQVVLSHGKRLDPAVLGPAPANFLLAPSVPQLEMLQRTSVFVTHGGMNSIMESLYFGVPLVVIPQMMEQEITARRVEELELGAALTQENATAEHLREAVARVQQDPSITQYVQAMQQQVRAAGGYQRATDAILDFAYKRASLTHSRSMEA

SEQ ID NO: 8490 - protein, 396 aa, Bacillus sonorensis
MEQRHIAIFNIPAHGHINPTLALTANLVKRGYRVTYPVTDEFVEAIEETGAKPLRYRSTLNMDPRQIREMMKTKDMSEGPLMFKKEVEEVLPQLEAIYEHDKPDLIIFDFMAMTGKILAEKLGIKAVRLCSTYAQNDHFQFSYLSREKYQAELTDEQKEALKNSNLPSFFEEVFKPADLNIVFMPRAFQPYGDTFDERFCFVGPSLSKRKFQEKESTALLHGDDRPVMLISLGTAFNAWPEFYQMCIDAFGGSKWRVIMAVGTTIDPESFANMPENFSIHQRVPQLEILKKASLFITHGGMNSTMEGLNAGVPLIVIPQMAEQEMTAERVNELGLGIHLKPEETTVAILQEAVSEVDGDAELMKRVQDMQKNIKEAGGAEKAADEIEAFLAPAAVK

SEQ ID NO: 8491 - protein, 401 aa, Paenibacillus forsythiae
MKRIHIAMINVPAYGHVNPTLAVVSELVKRGYKVTYPTTEQFLPAISETGATPLLYQLNDTQFDGEQMMEDVKMRNPNLPLTILEQAISFFAQLEQLYKDELPDFILFDFMGLAGKLFAAKHGIEAVRLFSSYALNEHFSFASDFPDETRKAMASVLEACSEKEGIPGLTVEELFRAEKLNIAFLPRAFQPESDTFDERYLFTGPSLGTRSYQESLPLSEIHDRPVLLISLGTVFNPWPEFYKMCIEAFRDSKWQVIMSTGTKIDPETLGEIPGNFIVRQQLPQLEILPHAKLFITHGGMNSTMEALSHGVPMVVIPQMFEQEITARRVTLLGLGQHYLPDEVTVQVLQQSVQEVSEDEQLRKRVYDMQKQIQEAGGAIKAAEGIEQFINETSRQNAHAAH

SEQ ID NO: 8492 - protein, 433 aa, Salinispora arenicola
MLIATTPAPGHVVSMVDVAGELTRRGHEVRWYTGRAFQEQVEQAGARFEPMSEALDFGGRSREEAFPSHAGLTGLASFKIGVRDIFYHTAPGQLDDLLRVLERFPADCILADDMCYGACFASERTGLPMAWLSNSIYILGSRDTAPLGLGLQPSSSPLGRARNALLRFLGDHVSMRDLRREADRTRASVNLPRLRTRAMENITRPPDLYLVSTVPSFEFSRSDLLPGTHFIGGLFGLPPERFEPPSWWQELDGDKPVVLITQGTTANDVDRLLVPAVRALAREDLLVVVTTGSDLDVDLLRPLPGNVRLERFVSYHHLLPRVDVMLTNGGYNGVNAALAHGVPLVAAPATEENPDVAARIAWSGAGVVLARRAVSEATLRNAVVTVLHDERYRQRAHVLSREHQRYDAPRRAAELIEAMAESQGRVPTGGPTQ

SEQ ID NO: 8493 - protein, 393 aa, Lysinibacillus yapensis
MSKIVFFSIPAHGHTNPTIPVVTELVNRGHKVWYYSFLEFQEKIKGSGAAFIACDEFLPNVSQKVLDRKVGKDFAALIEMIADTTIALDEKVCKELREIQPDCIVSDSLCFWGKLFAKKLDIPYICSTTSFAFNQYTAKLMKRNFMEIWRMIVGMPRIHKKMKLLQNHGYDVENFVEIVQNDNETDTIVYTSKEFQPLVHTFSERYAFVGPSIRQTSPIVNDKKDKTVVYISLGTVLNQNRNFYRSAIQAFANTGYEVVMSVGEQTEVSSLGNIPENFTVKNSVDQISVLQATDVFITHCGMNSVNESLYFGVPMVLFPQHSEQRIVADRVAELGAGVQLKGKKPNDLAAAVAEILADLSYYDNAQKLSKTFRNAGGAAEAADVIMAKIEERS

SEQ ID NO: 8494 - protein, 397 aa, Paenibacillus wulumuqiensis
MLRILIVNFPAEGHVNPTLGITEAFASRGDEVHYVTTEKYKERIEAVGATVHLHPDLVRTASIDTGNRESINEFMKIHIRTSLDILELVRQLSATIAFDLVLYDRFGAGELVRDMLNIPGISSSPSFPISNQHMATNLFRPSAESPAPPDEFVAESLSLMKEKYGVAPKEMIQFMNNSGALNIVYTSKYFQPNGEQFEEKNLFIGPSFPERKGSGSFPLEKLQGQRVLYISMGTVLDHIEEFFNTCIEAFSDFDGIVVIAAGEKADLAKINPAPDNFIISPYVPQLEVLRHADVFITHGGMNSVNEGIHFNVPLVVLPQDKDQPMVAQRLTELQAGYRITKDQIHVQSLREAVQEVLSNPSYKEGVHKINQSFEQCGGTEEALRRIDAYLLQRTGAK

SEQ ID NO: 8495 - protein, 403 aa, Paenibacillus sabinae
MKKTHIAMINIPAFGHVNPTLAVVSELVQRGYKVTYPATEKFVSVVEETGASVLPYHSSTTDLLDQLSHIKEINEVISNHSENLPMKFIEEAISTYYQLEQMYADDLPGLILFDFMALGGKLFAAKHGIDAVRLYSSYANNENVSTLHDISDEIKIELASKIKAFSEKEGITGVSFMELFAPEKLNITFMPRAFQLQGDLFDERFLFVGPSIGKRSYEESLPLGENNDRPVMLISLGTIFNPWPEFYKMCIEAFRNSGWQVVMSTGNKISPESLGDIPDNFIVRQQVPQLEVLPQARLFITHGGMNSTMEALSCGVPLVVIPQMFEQEITARRVTELGLGQHFLPDEVTAQVLQKSVQEVSEDEQLQQRVYDMQKNIQEAGGAKKAAEAIEKLLSLSNIQARV

SEQ ID NO: 8496 - protein, 392 aa, Bacillus subtilis
MKKYHISLINIPRYGHVNPTLALVEKLCERGHRVTYATTEEFVPAVQQAGGEAFVYHSSLTIDPKKIKEMMEKNETTLSLLKESFSILPQLEDLYQDDRPDLILYDFIALSGKLLADKLHVPVIKLCSSYAQNESFWLGNKDMLKRIKEAEAEFKAYLEQAQLPAASFEQLAEPEALNIVFMPKSFQIQHETFDDRFCFVGPSLGKRTEQESLLIEKDDRPLMLISLGTAFNAWPEFYKMCLEAFRNSSWQVIMSVGKSIDPESLGDIPAHFTIRQSVPQLEVLEKADLFISHGGMNSTMEAMNAGVPLVVIPQMYEQELTAKRVNDLGLGVYLPKEEVTVSRLQEAVQAVAGDQEVLSRVKNMQKDVKEAGGAERAAAEIEAFMKKSAVPQ

SEQ ID NO: 8497 - protein, 406 aa, Paenibacillus forsythiae
MKKAHIAMINIPAYGHINPTLAVVSELVNKGYKVTYPAVDQFIPVVKQTGASVLPYHSATLDVLDQLNHVKQINEIISSNSENLPMKFLEEAISTYYQLEQIYADDLPDLILFDFIALSGNLFAAKHGISAVRLFSSYAENEHVSALPVISDEIKDQLAAKLKEFTEKEGIPVKHFMELFAPEKLNIAFMPRAFQLQGDLFDEHFLFVGPSIGKRSYNESLPIHENRDRPVLLISLGTIFNPWPEFYQMCIEAFRDSGWQVVMSTGSKISPESLGDIPDNFIVRQQVPQLEILPHTKLFISHGGMNSTMEAMSFGVPLVVIPQMFEQEITARRVSELGLGQHFLPDEVTVQVLRQAVQEVSGDGQLKKRVLDMQKSIQEAGGAARAAEAIEQLINQSSLKNTQVAR

SEQ ID NO: 8498 - protein, 398 aa, Dictyobacter aurantiacus
MTKYAFLNVPAYGHVNPTLAVAHELVERGEQVSYYLTEAFRATIESTGATFQPYQMDEMRPPQGLTANPQNINISHLLGMLLRTSTIILPQVVERLRAERPDCIIYDFMCPAGYMAAQVLGIPAINLRPSYVPSKEMMSRGPLARAQASGSDLAALQEQLDALSARYDLPSMRPMDIWTHHEDLNICFIPRAFQPGGEAMDDERFLFVGPSIFMRQDAPPFELKRVEGQPVLYISLGTVMNNRPDFFRLCFESFADQPWHVVMAHGPRLDLSALGPVPANFQVASYLPQLEVLQQTSVFITHGGMNSTMESLFYGVPLIVVPQQPEQFMTGQRVSELGLGTALKTDELSVAVLRQAVERVSGDPTIRANVEAMQRTVRSSGGYRQAADAITRFAATHS

SEQ ID NO: 8499 - protein, 426 aa, Gloeocapsa sp.
MVHFGILCPAASGHLNPMTALGYELRQRGHQVTVVGLLDAKSKALAAGLDFRAIGEVAFPLGAIPKGVAKLGQLEGLAAFRYTVEFFKQVTLTLLQEAPAALQSAGVKALLIDQTSFGGSTVAEFLDLPFISVCCALMLNRDPNVPPFNTAWNYHAAGWARLRNQLGHELMSRIARPIVNEVVAYRQRWNLPAYCHPNDAFSHLAQLCQQPAEFEFPRQHLPACFHFTGPYSNPASREPSSFPFEQLTGKPLIYASLGTVQNQLLGTFQVIAEACDGLDAQLVIALGGGSKPESLPALPGSPLVVEYAPQLELLQRATLTITHAGMNTTLESLANGVPMVAIPIANDQPGVAARIAWTGTGEVVPLKRLSSSKLRSAIQRVLSEETYRENALRMQVAIRQAGGIKRAIDIVEQVVATGKPVRSRLS

SEQ ID NO: 8500 - protein, 393 aa, Lysinibacillus fusiformis
MSKIIFFSLPAHGHTNPTIPVVTELIKKGHQVWYYSFLEFQDKIEDTGAFFMACDEFLPKVTHIELDRKIGKDFAALIEMAADITIALDKKVCKELMDIQPDCIVSDSLCIWGKLFAEKLGIPYICSTTSFAFNQYTAKLMKRSFMEVWRMILGMRRINRKIKLLNDHGYRVENFVSLVQNDNETDTIVYTSKEFQPMADTFSERYAFVGPSIKQSIPIQNDKRVRKVIYISLGTILNQNQDFYQNCLKAFGKTDYDVVMSVGEKTEISSLDSVPENFIVKNAVDQISVLQKADVFITHCGMNSTNESLYFGVPMVLFPQHSEQRMVADRVAQLGAGLKLNRKTPKYLATAVAEVLTNRVYQEGAQKLSESFRKAGGAVEAANVILRKIGEKS

SEQ ID NO: 8501 - protein, 405 aa, Ruminiclostridium cellulolyticum
MSHVLFINVFGYGHINPTVSIVGELLDRGEKVTYVAGEEFKDKIEHMGARFIGYKNFDELGFNNGEISPAEIEPQLMEISRVYVEIIETVFNIKDNFDYIIYDSLFFLGAEIARVLKIPAISSDSTFAVNDKTNYMSEFFAKFGPVIMGLTSRPDFLSTINYLRDKYGIIVPDLFSIHKLKSDINIIYTSRYFQICGESFDDSYKFVGPSISDRKEKPESTLIYKDKSKLIYISLGTIFNKSVEFYESCFKAFGSMDVKIIMSVGMNIDISSFKNVPNNFIIRNYVPQLEILKYADLFITHGGMNSTNEGLYYSVPLIVIPHFFDQPVVAYRVAELGAGIVIEKDKVSPEILKESVNRIFSNKAYKENSEKIGKSLRGSGGYKKGVDEIFALKDSKKTTGNLIYI

SEQ ID NO: 8502 - protein, 426 aa, Chroococcidiopsis thermalis
MTHFGIICPSSTGPLNTMLPLGQELQRRGHRVTVIGILDARPKVLVAGLEFQVVGEDEFPEGAMAESFAQLGKLSGLAALAYTINLLKNLATVTLRDAPDLLQASNVEALLVNQGSREGGTVADFLGIPFVTVCSAVVLNREPSVPPFNTLWQYSPAWWARLRNRAGYALLNRVARPTRTVIQEYRREWKLPLHAHPNDAYSRLAQISQAPAEFEFPREKLPSWFHFTGSYHSSASREPVPFPYENLTEKPLIYASMGTLQNRLIGIFQQIASACEGLDAQLVISLGGSARPESLPKLPGNPVVVEYAPQLEILKKATLMITHAGMNTTMECLKYGVPMVAIPVTNDQPGVAARIAWTGVGEYVPLSRLNVPKLKAAIQKVFTENSYKQNAARLQQAIQKAGGVTRAADIIEQAISTGKPVLANVS

SEQ ID NO: 8503 - protein, 402 aa, Tengunoibacter tsumagoiensis
MTKFLYCAPPRYGHVVPMLAIVKEMIEQGAEITYFCTEQFAEAIQETGATFKPYKTTLIEDAHMQNIAELDFESSDPTVNESFYVLPQLIEVARAEKADCLIYDDFCLWGRILAQILRLPAIIMLSSYARNEQFNHFDYFRKRLQIDIPTIIATEDVRQSLVKLCETYKIEPFPFEDIFFHTEPLNLIRIPREFHPMGETFDEKRFKFVGSTIRSHEDIGDFPLDRLSKEPVLFATLGTVFTEVSGMFDLFLSAFGHQSQQLVIAIGKNIDPSVFGPLPENVILHPHVPQLTLLRHTDIFISHGGLNGVMEALANGVPMIAIPQVGDQVATAFRLQELKLGIMLDPSIVTVHTLRTAISILKKDPAYRANAQRMQKIVQQLNGARDAAREILDYSHSLFVNK

SEQ ID NO: 8504 - protein, 426 aa, Pseudomonas monteilii
MTHFAVVAPAYASHFQAFEVLSGALLDRGHRVTFFHQVDAARWLQDRRIGFQPIGVDSRPPGTLDAQLRLAASPSTPWALHRLIRQLADTSRLFIEHLPAAFAAQHIEAVLCDQMEGAGGLVAEALGLPFVSLACALPVNREDGLPLPVMPFAPGQAPYSLRRCHASTQVYDWLMKPVDAALMQGARRLGVPPRRGLHAYLSPWLQLSQTPAALDFPRQSLPAHFHPVGPLRRATPDRPGAWPIDPNRPLVFASLGTLQGGRLRQFQRIARACRALDVQLLVAHCGGLDPAQEATLQRCGATWVTDFAPQRWILEQADAVVTHGGLNTVLDAIVAHTPMLVMPIAFDQHGVAARVAHHRLGLSLSRRASTRRIADALRQVLALPTQAHARQAEALAASGGAARAADLIEAALGVPASSPLETVDDL

SEQ ID NO: 8505 - protein, 395 aa, Paenibacillus sp.
MLHILMVNFPAEGHVNPTLGITQAFAARGDQVHYITTEKYKDRLQAVGATVHLHPDLIRTASIDTSTPAGLNAFMNIHIQTSMDILAITKQLSESIDFDFVFYDRFGAGELVRDYLNIPGIASSPSFLISKNQMASNLFRSDAKVPFQLNEQAATSLELMKERFGVAPESMVQFMNNTGALNVVYTSRYFQPDAERFGEESLFIGPSFPERKGEHSFPLDRLQGKKVLYISMGTVLDHIEDFFNTCIEAFSDFEGIVVIAAGEKADFTKINPAPEHFIISPYVPQLEVLRHADVFITHGGMNSVNEGIHFNVPLVVLPQDKDQPLVAQRLTELQAGYRITKDRIHVQSLREAVHEVMSNAAYKEGVQKINDSFQQSGGTEEALAKIDAYLQKELA

SEQ ID NO: 8506 - protein, 405 aa, Ruminiclostridium papyrosolvens
MSHVLFINVFGHGHINPTISVVSELVDRGEKVTYIAGEEFKDKVESAGARFIGYKNFDELGFNNGDISPAEIQPQLMEITRVYVEIIEVIFSIKDKFDYVIYDSLFFVGAEIARILKIPSISSNSTFAVNDKTNYLSTFFTRFGPVIKELLNNPDFQGTIHFLREKYGVNVPNILDMHKMKSDLNLVYTSRYFQINSEGFDDTYKFIGPSISDRQEILEPELISKEKSKIIYISLGTIFNKSVEFYESCFEAFIGMDAKIIMSVGMNIDIDSFKDIPDNFIIRNYVPQLEILKHADLFITHGGMNSTNEGLYYSVPLIVVPHFFDQPVVAYRVAELGAGIVIEKAKVSPALLKASVTKIFSDNAYKENSEKVGKSLRESGGYKKGVDYIINLKDSKEAAGELIYS

SEQ ID NO: 8507 - protein, 401 aa, Unknown
  Description of Unknown: Actinobacteria bacterium OV320 sequence
MTSRPAHIAMFSIAAHGHVNPSLEVIRELVARGHRVTYAIPPVFAEKVAATGAEVKPWHSTLPAPDDDPSAWGSTLLDNVEPFLADAIQALPQLIEAYDGDEPDLVLHDITAYPARVLAHRWGVPAISLSPNLVAWEGYEEEIAEPMWAEPRETERGKAYYARFHAWLEENGIAEHPDSFAGRPARSLVLIPRALQPHADRVDESVYTFVGACQGDRAAEGEWTRPERAEKVVLVSLGSTFTDQPDFYRECVRAFGEMPGWHLVLQIGRHVDPAALGTVPDNVEVRSWVPQLAVLRQADLFVTHAGAGGSQEGLATATPMIAVPQAVDQFGNADMLRGLGVARQLATPEATAATLREAARALVDDPETARRLKVIQEEMADEGGTRRAVDLIEAELMRQRS

SEQ ID NO: 8508 - protein, 394 aa, Bacillus sp.
MEQKHIAIFNIPAHGHINPTLALTKKLVERGYRVTYPVTEEFTTAIEETGAKPLQYRSTLNIDPRQIREVMKNKETAQQMPEMFKKEVDEVLPQLEAFYENDRPDLVIFDFMAMAGKIMAEKFGVKAVRLCSTYAQNDHFHFRAMAETIQMGKNAEQLPDLNNANIPYFEEIFQPANLNIVFMPRAFQPYGDTFDERFRFVGPSLAERKFQEKDIPLVKDDGRPVMLISLGTAFNAWPEFYEMCIEAFRDTKWQVIMSVGRTIDPESFKDVPENISIHQHVPQLEILKKAKLFISHGGMNSTMEALNAGVPLVVIPQMPEQEITARRVEELGLGKHLQPEETTVRSLQEAVSKVDDDAQMLNRVKDMQKNIREAGGAEKAADEIEAFFKLLTVK

SEQ ID NO: 8509 - protein, 395 aa, Lawsonibacter asaccharolyticus
MYRIAFFSIYAHGHTNPTLPVVRELTCRGHQVRYYSFAPFREKIQAAGAQFVPCDSYLPPAPPDLERRVGRDFAALVEMITQTLLAMDGPVGRDLAQFQPHCVVSDSLCFWGKLWAAKLACPYVCSTTTFAFNRHTAKLMKQTPGQFLRLLTGRGRIRRCMAQLCQAGYPMKGLLSLIENDGHTDTIVYTSWEFQPLADTFSSRYAFIGPSVPELTHAPRSGGDRQIYISLGTVNNRSRSFYRACLEALRSWEGVRAVLSLGGGCRPEELGDVPPNVQVFPQVDQLAVLSQSDAFLSHCGMNSVSESLYLGVPLVLFPQQEEQGMVARRVQELGAGIPLPAPTPAAIHQALSLVLADPAFQHSAQHISEGFRAAGGYRRGADNILEAAMGSAPLP

SEQ ID NO: 8510 - protein, 433 aa, Geitlerinema sp.
MSHIGVLCPGAIGHLNPMCNLGGELIRRGHRVTLFGVPEVREKIARSSLEFCEIGASDFPPGSIDKMYAQLGKLTGTEGLKFAIQFFQDEAKMLFRDAPSAIRNVGIDILLVDQVTGAGGTIADYLQLPFITICNALPIQQEPSVPPYFTSWEYSDTRLARLRNRLGYRLVNFFTRELWDTFVQQRKQWNLPPHAQRSDSYSGLAQIAQLPQELDFPRKQLVPWFHYAGPLKNPLEIEPVSLDQQHFSFDSLSNKPLIYANLGTLQSHNWKIFHAIAEACLGIDAQLVISLGNPKADPSQTNFPGNPLVVPFPPHQQLINRAELVITHAGSTAVSCLSSGVPMVAIPITTDQPGMAARVKRVGAGEVVPLKKLSVSHLRTAIQQVLGDRAYRENAARLQTAIQAAGGVNYAADVIEQVIRTQAPALNPRLQPS

SEQ ID NO: 8511 - protein, 399 aa, Steroidobacter sp.
MKSRHIAVFTLLTNAHLYPVLGVCSELVNRGHRVTFATNDRYAPVVKQTGAEVVIFKDVKVENAAAFSTASAFYDQNFYTIWASIVGPFLILFAASAFPQLENYYKENKPDLILYDRACFVGRMLAARLGCSAVQLSPHFAPYGDTFIRENGVFLNPSPIPSFSQVLDCFLQAYGVQSKNNLTHAADLNIFFIPREFQFHGDSFDDRFCFVGPCLNRPAASEWRNNSGGKPIILVSGSQADEGTTYFRTMINAFSGSDFHVVLSPGANVSDDLFGPLPSNFELNRVAYNFQIIPHSTLTISQGGTGTVMETLYYGVPLLAVPRMPVHAETAYRLAELGLGGYLPEQMMSADSIREQVTQLLGDTSLASRIARMQHIVRDSGGAKIAANRIEQCLGSRPS

SEQ ID NO: 8512 - protein, 404 aa, Paenibacillus durus
MKKTHIAMINIPAYGHINPTLAVVSELVQRGYKVTYPATEKFIPDIEQTGVSVIPYHSASMDILDQISHVKQITEAISSNAENLPMKFIEEAISTYYELEQIYADDLPDLILFDFIALAGKLFAAKHGIEAVRLFSSYAENEHVSALPEVSDEIKNELAAKLKDFAEKEGIPVASFMDLFIPEKLNIAFMPRAFQVKGDQFDEHFLFVGPSIGKRSYDESLPIDENNERPVMLISLGTIFNPWPEFYNMCIEAFGGSNWQVVMSTGSKIIPESLGDIPDNFIVRQQVPQLEILPHTRLFITHGGMNSTMEALSNGVPLVVLPQMHEQEITARRVTELGLGQHFLPDEVTVQVLQTAVQEVSEDEQLQQRVYDMQKNIQEAGGAQKAAEAIEKLLHSQKNTQVTH

SEQ ID NO: 8513 - protein, 389 aa, Holdemania filiformis
MAIIAFFCLPAYGHTNPTLEVVRELTKRNHQVVYFSFSPFQQRIEEAGARFINCDAELSMDKAGAMAANSDVGGSIKLLTDTTLALDKKICETLQALQPDCIVADSMAVWGKFAALKLGIPLISSTTTFAFNRYSAKIMKQSFGQLFSLICSMPQIRRQIRRLREHGYPVKNLLSILQNDDQTCTIVYTSREFQPYAETFSDRIQFVGPSLRQISTEAADARTAVYISLGTVNNQHPDFFRNCVEALRDYPGEVIMAVGTENQAAALEAPAHFTIRPQVDQLEVLQKAALFLTHGGMNSVNEGLYAEMPLILYPQTAEQGGVARRVVQLNAGILLEENSPAAIRRAVNQVLTNPVLKENAAAISRSFRQAGGAVRAAQLIEGWIQEKKN

SEQ ID NO: 8514 - protein, 395 aa, Bacillus massilionigeriensis
MSKIVFFSIPAHGHTNPTIPVVSELVNRGHEVWYYSFTEFQGKIEGAGAKFISCDKFLPPISEEELDRKVGKDFAALIEMVVDTTIALDEKVCTELKEFQPDCIVSDSVCFWGKLFAKKLGIPYVCSTTTFAFNQYTAKLMKRGFKEIVRMIFGIPRISKKMKLLRNHGYQVDNFISIIQNDNETDTVVYTTKEFQPMAETFSDKYTFVGPSIRQSSEMPVDKKGSKVIYISLGTVLNQNKDFYQHCFEAFADSDYEVVMSIGEKTEMASLGHIPDNFSIQKYVDQIAVLQRADVFITHCGMNSVNESLYFGVPMVLYPLHSEEGAVANRVAELGAGIKLQGSHSKNLEKAVAELLTNPSYLGNAQKLSVNFQNAGGAGEAADVILAKAERKPYK

SEQ ID NO: 8515 - protein, 395 aa, Micromonospora aurantiaca
MPHIAMVSIPFHGHVNPSLEIISTLVRRGHRVTYANDPAFAEVVRATGAELKPYASTLPADGGAGIDDPIAQLTLFLDDAVAMLPQLRTAYADDRPDLFLYDIAGAPARLLGEQWGIPAVQLSSTFVAWDGYEQEMAPAVEAMRADPRGADYYQRFTAWLTAEGSSVTDSMAFQGRPVRSLVLPPEALQPNADRVDRSVYSFVGPVLGDRSDQGSWVRPERADKVLLVSLGSAFTRQPEFYRRCVAAFGDLPGWHTVLQIGKHVDPAELGPVPDSVEVHRWVPQLAVLEQADAFVTHAGMGGSSEGLYCGTPMIAVPQAADQFANAEQLASLGVARVVDSATVTAAELRETLLALTADPAVVARSAELKRQARAAGGADRAADLIEAELATASGG

SEQ ID NO: 8516 - protein, 439 aa, Variovorax paradoxus
MARYLIAATALPGHVLPMLAIAQHLVNQGHEVRVHTASQFRAQAEATGASFTPFERAIDFDYRDLDKRFPERQRIASAHAQMCFGLKHFFADAMAAQHAGLSSILEDFEADAILVDTMFCGTFPLLLGKAREDRPAIVGIGISALPLSSCDTAFFGTALPPSATPEGRVRNKAMNANLKQAMFGEVQRYFDTLLARSGLPALPDFFVDAMVKLPDLYLQLTAPSFEYPRSDLPASVHFVGPLLSPASRDFTPPEWWHELDDGRSVVLVTQGTLANQNPSQLIGPTLQTLAGDKNILVIATTGGPVPPALTVNLPANARVVPFLPYDRLLPKLHAMVTNGGYGSVNHALSLGVPLVVAGTSEEKPEIAARVAWSGAGINLATGQPTARQVGDAVRKVLGNSSYRQRAAVLREDFACHRALTGIAGALEALLQTSASAEMA

SEQ ID NO: 8517 - protein, 300 aa, Paenibacillus zanthoxyli
MMNILMVNFPAEGHVNPTLGIVKAFADRGDNVHYITTEKFKERLSFLMPEKEFKNILGPDSFQPDENAERLLDQMKEKFDVLPKNMLQFMNNSGDLNLVYTSRYFQPHNELFGENYVFIGPSFPQRKTTDHFPMEVLKDKKVLYISMGTVLDHVEEFFNTCIDAFSDFEGKVVIAAGEKADFTKIKEAPENFIISPYVPQLEILSQSDVIVTHGGMNSVNEAIHYNVPLVVIPHDKDQPMVAQRLTELGAGYRISKDNINVSSLKNAVNEVLSNSEYKEAIQKIKDSFHMCGGPEKAIEV

SEQ ID NO: 8518 - protein, 392 aa, Bacillus halotolerans
MRQHHISIINIPAYGHVNPTLALVEKLCEKGYRVTYATTEEFAPAVKQAGASPLLYQTTINVEPERIREMIEKNETPISILKESFEILPQLEDLYQNDQPDLIVYDFIAFAGKLFADKLNVPAIRLCSSYAQNESFQLGSEEMLKQLKQAEADFQVYLEKENLPAVSFEHLAIPEALNIVFMPRSFQIKNETFDERFCFVGPSLGKRGEQESLLPETGNRPLMLISLGTAFNAWPEFYRMCIDAFRNSDWHVVMSTGISIEPDSLGDIPDNFTVRQRVPQLDILAKADLFVSHGGMNSTMEAMNAGVPLVVIPQMYEQELTARRVDELGLGVYLPKEEVSVSRLQKAVQDVSRDKEMLNRVKDMQKDVKEAGGAEKAAAEIEAFIKKSVVPQ

SEQ ID NO: 8519 - protein, 396 aa, Streptomyces sp.
MTSHIAFFNFPAFGHLNPTLGVVAELVKRGHRVTCTTTDHFAPAIESLGAEAVRYNSVFGQYYTNPFTAEAISGEGLRTLEESLSLVDQVEGFYQDNRPDVILHDFMAWGGRFYGATRDIPVMRLFPSYGMNEHFSIQAKFPMAEFSDPLVMEMIARLDEKLPDLGFPGKTAMEFFMEPPQRGIIFLPRDFHYDGDTFDERFVFAGPCLGDRSGFQGSWQPASQDRPVLLISLGTAATGWPEFFKTCVEAFTGSRFDVVMAVGDNLDPAELAPLPANFEVRRSVPQLDVLRHADLFITHGGMNSVMESLYNGVPMVVSPQMSEQRANGLRVEELGFGRMLTREDFGLESLRKAVDEVSADRAIADRTRAMGERMRQVDGPAVAADAIESYVAASGR

SEQ ID NO: 8520 - protein, 393 aa, Streptomyces otsuchiensis
MAHIAFFNFPAVGHVNPTLGVVEELVKRGHRVTCTATEFFVPAIKAAGATPIVYESPFGEFYRSPYNDEMMAGEGLRCLDEAIALHQQVSGYYGDDRPDVVVHDFMAWGARFYASEHELPAVRLFPSYGVSETFNIAAKYPWSAPDDPRILEMIERITALLPTFGLPGDMGAFVTDVAETGVIFLPREFHYEGDTFDDRFVFAGPSIKDRSTFQGSWKPKSAERPVLLISLGTASTGWPEFFSLALQAFGDSHRDVVMALGDHIDPADLGDVPANFEIRRHVPQLDVLRHADVFLTHAGMNSTMESLYHGVPMVAVPQMNEQRANALRVEELGLGRHLPREEVTAESLRASVDAVAADAAVAERVRAMKEALRAVDGPAVAADAVERRIVANG

SEQ ID NO: 8521 - protein, 403 aa, Unknown
  Description of Unknown: Pseudonocardiaceae bacterium YIM PH 21723 sequence
MTKHIAIICMPAHGHLTPVLAVTRELVNQGYRVTIPTLEEHRAQVEASGAAAPLYHSPLVEQFAAKKDEMRDAPPAEFKVEEILPMFFGEAGATAPQFVELFENDRPDLLVYDQITWAGALVADRWQVPHVILYPSTVPTQGSNAFRDMVEQIADPGTAAAVQGALDTARAGSGLEPLPVLDFLGTQPELGIAFMTRSFQPEGETLDDRYQFVGPCLGDRISNTGWQPKDAERPLLYVSLGSGFNNQPAFYRTVIEAFRDEPWQVVLVTGQSVQLSELGDDLPDNFEFHAFAPQLEILPHATVFLTHNGMGGTQEGLSFGVPMLGLPQMSEQETNADRVVELGLGRRLPAKPTAAELRAAVAEILEDPDIHKRLEAMKWDIEAAGGTKRAADLLADAVRRFQA

SEQ ID NO: 8522 - protein, 390 aa, Bacillus sinesaloumensis
MSKIVFFSLPAHGHTNPTIPVVTELVKKGHEVWYYSFSEFKQKIEDAGATFIGCDDYLPRVSEAEVERKVGKDFAALIEMVADTTIALDKMVCEELQELQPDCIVSDSLSIWGKLFAKKLDIPYISSTTSFAFNRYTAKTMKRGFKEIWRMIVGMRRIQAKIKQLNEHGFKVENFVSLVENNNDTDTIVYTSKEFQPMAETFSERYAFVGPSIRESVPTQHKENRKIVYISLGTVLNQNQDFYENCIKAFADADYDVVMSVGEKTDITSLGNIPEHFTVKNTVDQIAVLQEADVFITHCGMNSANESLYFGVPMVLFPQHSEQRMVADRVAELGAGVMLKGSKPNDLATAVADLLGNPSYQKHAQALSESFKKAGGAERAANVILAKIND

SEQ ID NO: 8523 - protein, 403 aa, Unknown
  Description of Unknown: Pseudonocardiaceae bacterium YIM PH 21723 sequence
MSHFAFACMPAQGHLMPLLAVTRELVGRGHRVTIPTTKEFQQQVEASGAAAPLYEQPSNREFGDDPDLMREAKPDSFPLAAVFRMFLDEAAGVAPQVKSILDGDRPDLFVYDQMTWAGWLLADKWRVPHVMLFPSLVTGQQRPSFAAGIEQMSDPETRASLDDAVAATRAALDLPPAALSEFGAHEPELGIAFLPKAFQPDAEQIDERYEFVGPCLGERTGTTGWQPPAGDLPLVYLSLGSAFNQQPTFYRTVIEALRDEPVRVEMAIGEQVKPEELGEIPANFRLHGFAPQLEILPHASVFITHCGMGGTQEGLSFGVPLIGVPQMFEQQMNAERVVQLGLGKHIPPAEVTADRLRTAVRELLADPEIGGRLTAMRAAIQTAGGSARAADVLEHALTQYANR

SEQ ID NO: 8524 - protein, 393 aa, Paenibacillus sp.
MSKIVFFSIPAHGHTNPTIPVVAELVNRGHQVWYYSFLEFQEKIEGAGAAFIACDEFLPQLSQKELDRKVGKDFTALIEMVADTTIALDEKVCQELREIQPDCIVSDSICFWGKLFAKKLEIPYVCSTTTFAFNQYTAKLMKRGFIDVWRMIVGWPRMNRKIQLLKNHGYEIGNVVSIVQNNNETDAIVYTSKEFQPMADTFSERYAFVGPSIRQSPPIQINKKDRKLIYISLGTILNQNQDFYQKVIQAFADTDYDVVMSVGEKTEIASLGNIPRNFTVNNVVDQISVLQTADVFITHCGMNSVNESLYFGVPMVLFPQHSEQGLVADRVAQLGAGLKLKGKKPKYLAAAVSEVLTNRTYQENAQKLSETFQNAGGAVEAANVILTKIRAKS

SEQ ID NO: 8525 - protein, 400 aa, Deinococcus maricopensis
MSIVAVFTLSALGHVHPTLPIVAELVRRGHRVVYYCGEAVRQKIEATGAEWRAVPWDFTPVERAPRPRLSAYALEQARCAETLLPQLLKELQDLNPACVMVDFMCFWGRIVARTLQLPTVNLSSSFALGPGVLPPRPVLMALDLAGAPLQGAREVLAVRRTTQRLSRQYRQADLRTQFDLLSMDGDDVLVCTARAFQPHAERFGERFQFVGPSVAPRAREATTDLPRLDERPLVYVSLGTVFNHKLDFFRECVHAFADGQYQVILSVGQSTDPAALGPLPPHMHARAYVPQLDVLARAAVFITHAGMNSVSEAMAHEVPVVAVPQAADQFTIAQRVAALGVGRNLLPFQRRARHLRAATDALVADAAVRSRCRALRQAFEQAGGPTRAAAVIEARMAGQA

SEQ ID NO: 8526 - protein, 406 aa, Ktedonobacter racemifer
MSNIVYLSLPAHGHVNPTLPVVQELVQRGEQVTYYSASEFCPQIERTGATFRAYPITEMTSTAFSAILQDGNLALVVRLLLHTTEQLLPFLLDELSREQPDLVVFDSNALWGNMAATLLKLRPAASIPHLVFDGTEARKAPHARQQIFRLLPMVPDLLSVRRRLIRRYGKAAFPSSRPLFPMRGGLNIVFTSRELNPDVPLIDQTFRFVGPSINPQTRDGDFPFDALGLQPVVYISLGTVHSTRSEFYRQCFEAFAGYPAQFILSAGTHTDIKELGAIPPNFIVCPFVPQLEVLQRVDAFITHGGLNSIHEGLYYGVPLILIPQQLEQFLNAKAVAARGAGLVINDQLMHGHVRASTLHQAAEVILADPRYREAAGALQKTLHTAGGYRQAADEIQRYLAREGVQT

SEQ ID NO: 8527 - protein, 422 aa, Caulobacter sp.
MARFLFTTWEGGGHVQPMLLVARELAARGHQVLALSDPCNAPDAAALDVPFRAWTTAPFQTGKTRDDDRLKDHQADSPLEVIQRLLDRVMTGPALAYARDTLAAIDAFAPDVVVSQELLFGPMAAAEARGLPLALLAANVWSLPTMSGAPPFGAGMLPAANDEERAMHAMVGQMSRGFYQAGLPDLNAARAVLGLVPLSDLFDQLGAARAILLATSRAFDFAPSPLPAPFAHVGPYLTDPAWVEAFEPPKGEAPLVVVSFSSLYQAQEPVLRSVITALSDLEVRAVVTTGPTIDPEQFQAPPHVMVVRSAPHGALLDDAAVFITHAGHGSTLRPLMAGVPLLCLPMGRDQHDNAARAIHRGAGLTLPADSKPELIGAAVRQLLDEPHFKIAASALGSAILAEARPDSASTTLEALLFEAQKN

SEQ ID NO: 8528 - protein, 422 aa, Dictyobacter sp.
MSTYLCFNIPQSGNVNPTLAIVQGLITRGEYVTYYLTREFQRPIEATGALFRSYTSNLDFSAIITAMSSKSSTERFLMLSESMLHESRAILPQILNDLQGWRPDGIIYGQSALWGRMLAQILHVPAISVRSSYATNQYFHLFSPLLPAVNPLEAERVKQRQDSLNRQLHSLCREYHIPTFDFTDIFSHAEPLTLVTMPRAFQYAGNTFDNRFKFVGPCILPRHDNSGFALERLGNHPILYISLGTSFNQQPDFYQTCLKAFANTPWQVVMSIGTHVTPAELEPIPENFIIRPYVPQLDILSRTSIFISHGGMNSTMEALSYGVPLIIIPRIQEHELTARRVVELGLGMELEPENVTAESLREAVNTIAHQPEIRMRTRQMQRTIAETGGVHAAVDAILQYLHTRRHSGSPLDCAQFTSETLS

SEQ ID NO: 8529 - protein, 425 aa, Solimicrobium silvestre
MTEKTIALFPEASYGAALNCLGIAQELLKQGARPVFICHPGFHGVFAEYGFPEYRLFTEQESDDAGNIDWTKFVQQHREAFRTSAFEQIDSYIAPTWEAVVASVIRIEVPLRQLLSRLKPAAIVVDNVIAFPAVINSGIPWVRVVSCAETEITDPDIPPYLSGCASKDRADWEQFSEHYASAIAPIHERYMTFLRSCDLAPFQNDEFMETSPWLNLLLAPKILRHQRQNPLMPDKFIFLEGCVRTEVPWHAPRFASHNDKPLVYTSFGSLGAMDIELFERMIQVFATLPYRFIINVGSWREHYQTTPDNVYLDSWFPQPSVVRETQLFIHHGGNNSFCEALYFGVPSLIMPYCWDGHDNAQRAQETGVGKHLPRYEWSDEQLRATITALIDDQAMHKRLQLNAKHMQASNGAQVAAAAILHAIKE

SEQ ID NO: 8530 - protein, 408 aa, Streptomyces libani
MSAFAATPQRHVAVFLFADFGHISPTLGLTRELIRRGDRVTYFVDHQYSEVVERTGARVVGYKSRRGAFVKVPQAGAARLAAEGYELLVESMQTVYPLALSTLAADPPDVVLYDFESFPAARMTAHTLGCATTVQLGISHASNEEFSLRVLLFDPDDPSLREGGAALMRFARDNGIPPEGLGRFLREWDEHNLAFLPREFQIKGTTFDERFHFVGPTVAEPEGDVPWSPPADGRRLALVSLGTESNQQRDFFRTCVDAFDGDDWHVVMTLGRDADLAALGDLPPHVEAHRWLPHPAVLPHADVLVCHGGMSCLMEALYFATPAIVVPQAFEHTLTARRVDELGLGRMIDRDRLTTDTLGAAVDDIVADPEIPEHMAWMRASVHGAGGAPRAAGLLEQWAGRPAPTPAA

SEQ ID NO: 8531 - protein, 217 aa, Paenibacillus polymyxa
GALNVVYTSRYFQPDADSFGEENLFIGPSFPERKGEHSFPLDALQDKKVLYISMGTVLDHVEDFFNTCIEAFSDFEGIVVIAAGEKADFTKINPAPEHFIISPYVPQLEVLRYSDVFITHGGMNSVNEGIHFNVPLVVLPQDKDQPMVAQRLTELQAGYRITKDQINVQSLRDAVHEVMSNAAYKEGVQKINDSFQQSGGTEEALAKIDAYLQNKLV

SEQ ID NO: 8532 - protein, 270 aa, Unknown
  Description of Unknown: Actinobacteria bacterium OV450 sequence
IDQLAAVLAAHGLQSFTRRRLLSPPRRALALFPRAFQRSPDTVPILCDYVGPAYAKRQLSKDWPRTRDGRPVLLISLGTLYDNDLPFFRMCIEALGDTRWHVIMKIGRRVDTAALGALPRHFEVHYSVPQFDILAGADLFIGHGGMAGVMEATVHSVPIVAIPQVAEQRVTAEQVALNKIGVHLPRQLVTASSLRDAVLRAASDPDIVHGIAVMQRHIQRSGGAPAAADLIEKLLPHGWPPGNRPPPLPVCSRSGDPLPIVPKVTSGMEE

SEQ ID NO: 8533 - protein, 390 aa, Lysinibacillus timonensis
MSKIVFFSIPAHGHTNPTIPVVAELTKKGHQVWYYSFLEFQQKIEDASATFIACDEFLPKVSQEELDRKAGKDFAALIEMAADMTIALEEKVCRELKEIQPDCIVSDSLCIWGKLFAKKLGIPYICSTTSFAFNKQTAKLMKQSLSEVWKMIVGMPRIHKKVKLLNDHGYRVENFVSLIENDNETDTIVYTSKEFQPLAETFSEHYAFVGPSIRKFAPVQNDHKTKKLIYISLGTVLNQNMDFYQNCMKAFSNTNYEVVMSVGDKTDISSFGSIPHNIIVKNTVDQISILQKADVFITHCGMNSTNESLYFGVPMVMFPLHGEQKMVAQRVFELGAGLKLKKLNPKMLAITVAEVLTNPSYKNCARKLSESFKRAGGGKEAANVILDKIS

SEQ ID NO: 8534 - protein, 552 aa, Anopheles gambiae
MLVLAYDLRSPTMTTQHWIALTLALAICNVHAENILFLQTTPSKSHHIWNRQIFDRLYENGHNLTILSFEQETSVPGKTFLVMDGYYAKMMAAFADSAGDFSSYEHAFGNIMNVYQYYKVASGLLEEEDAIQRLLAYPRTFRFDLVIHDFTMGQWLLGFLEHFHNPPLVSISPYNIPSYTQYLADVPVYTTYLPHPASSFGTRMTFVERVQNTLYWWFDMLYRQQVYMPQEQQRLVRVFEGANRTHVKLLERRSELVLVNSDPALDFYQLLPPNVVQVGGLHIKRAEEMPPVSLEGQFIARANKGVVLFSFGTNVQSEMLGAEVNRQLLELFASMPDYGFIWKHANADGLIMPPNVLMAPWVPQSAVLANGRTKLLVSHGGLLSLQEAAWNGVPVIGVPFFADQFSNVRRIELAGIGIGIPSTQLNAVTLKEAMDKILSDSSYRARSKELSYRFRTQPEPPLERAIFWIEKTIANKGLRYLRSPTRSMAPYQVYGLDMVGVVLLIALGYYLIFKLLLRCCIQLVFCLLLSTVGSRNRTVGARSPAVYCAAAN

SEQ ID NO: 8535 - protein, 407 aa, Unknown
  Description of Unknown: Actinobacteria bacterium OK074 sequence
MHATPRTPRRRAHIAMIGAPMVSHVRPSLDIVRELVARGHRVTYANDPATAELITPTGAELVPVPSELPFADGDWPEDPIAAMRLFLDDAVRALPRLRAAYDRDPADLYLYDIAAYAARALAEAQGRPLAQLSPTFVGWAGYEDEVAAHVWKLPGADAYRARFTEWLAGSGASTLDMDVFAARPAHTLALIPRAMQPHADQVDTDTVTFVGPCFNLREEEASWVRPADVTNVLLVSLGSAYTRQLGFYRRCLAAFGGLPGWHVVLQVGKHTDPRDLGPIPSNVEVHSWVPQRAVLARADAFVTHAGMGGCGEALLAGVPMIAVPQGAEQFTNADRLVELGVARRLDTADATAEALRAALLALTGDPEVARNSARLRADALAEGGTARAADFVEGLMEGLVEEAPGPR

SEQ ID NO: 8536 - protein, 402 aa, Paracoccus tibetensis
MARIAFCLPAMRGHLGAHAPLAREMARRGHEVVLLGSRALPPLVQGLPVRAMDWTEPQLSGAGLARTLWATAAATRGVVRHAPAALAALAPDLAVTDHAEPGYALAAEAAGIRRITLTPGLPILRNDAVPPPFLPWPFDPSEAGRGRNRGGWKVSGALMALQNRALAQGCRQHGLAPRAGIDDWSADVPELRQMIPALDFPQDWPANAVPLGPLRDDPRAGLPPLPDQPVIFASLGTLAGRRKRLLHAICAAAAPLDVTLILTHAGALTSAEIAALPGRPLVRDLWPQTAVLARASVCITHAGLNTVLDCIAAGVPMLAMPLAFEQPGIGARIAHHGIGLTLPPRQRDVAAIRAALTRLLGERAFRDNLSRPRAELRAAGGVRRGADLIEKMIRGRAAGDAA

SEQ ID NO: 8537 - protein, 402 aa, Bacillus thuringiensis
MANVLVINFPGEGHINPTLAVVSELIQRGETVVSYCIEDYRKKVEATGAEFRVFENFLSQINIMERVNEGGSPLTMLSHMIEASERIVTQIVEETKEEKYDYLIYDNHFPVGRIIANILQLPSVSSCTTFAVNQYINFHDEQESRQVDEMDPLYQSCLAGMERWNKQYGMKCNSMYDIMNHPGDITIVYTSKEYQPRSEVFDQSYKFVGPSIATRKEVGSFPTEDLKNEKVIFISMGTVFNEQPALYEKCFEAFKDVDATVVLVVGKKINISQFENIPKNFKLYNYVPQLEVLQHADVFVTHGGMNSSSEALYYGVPLVVIPVTGDQPFVAKRLTEVGAGIRLNRNELTSQLLRETVKKVMDDVTFKENSRKVGESLRNAGGYQRAVEEIFKLKMKPYVKIK

SEQ ID NO: 8538 - protein, 398 aa, Streptomyces sp.
MPPHRSHIAMIGVPIVSHVLPGLAIIRELVARGHRVTYANDPFVADRIEATGAELVPCSSVLPVADDNWPTDPVAAMDLFLDEATQALPQLHAAYDQDPADLYLYDIGAYAARALAESQGRPLMQLSPSFVAWEGYEQEVAAHLRALPGASAHRERFGRWLAGCGATTLDVDAFSGPPARALALIPKAMQPSADRVDPDTVTFVGPCFDARADTDRWTRPRDAEKVLLISLGSAYTHRPEFYRQCLAAYGNLPGRHVVLQIGRHTDPRELGDIPPGVDVRSWVPQRAILEQADAFVTHAGMGGCGEGLLAGVPMIAVPQGAEQFMNADRLVELGVARRIDTPDATAKTLRAALDDLVTDPETARRSARLRAAARSEGGTPRAVGLIEAMVAREGVGSR

SEQ ID NO: 8539 - protein, 392 aa, Streptomyces tubercidicus
MAKHLLFVALFGHGHVNPTLPLVEELVRRGHRVDYATTAEHSEAVIKAGAHWVELKLQSPALLTPPHNFGLDKIPGWMRGMFAEMRTLHPVLRDYCAAESPDAICYDSMNWPARVAAEQLGLPAVRFVPNLASNEAFSLFDNLMNEVGDEDPMLAALAADCAEFSAENGVTLAPELVLNFTEKLNLVFIPREFQPAGDTFDDRFHFIGPSLGEREHAEPWSPADPDAPVLFISLGTVFNDRPEFFRTCIEAFGDGPYQVAMAIGDLDRADLGEIPPTFDVRPYFPQPAVLRHADAFVSHAGMNSTMEALYYGVGLITVPQMPEQAANAGRAQELGLGVQLDTATVTAESLRAAVARVTSDATMRTHLDRMCKVTRDSGGAVRGADVIEEYIR

SEQ ID NO: 8540 - protein, 414 aa, Unknown
  Description of Unknown: Mycolicibacterium gilvum PYR- GCK sequence
MAVILAYTAPALGHLFPFCAVLQELARRGHDIHVRTLAAGLQICRDEGFTAAAVDPRIEAIQADDTLTGTVRAAADTVEVLTARAPLEVADLLSAVESVQPDVVIVDANCWGAMSVAETLGRPWVVLSPFTPYLRSPGAPPFGPGATPWPGPLGRIRDWGIGLVTTAVFDRPFARQIAPLRRALGLTPVRTAGDLLLRAPAVLVATGKPLEYPHTDWGETVTMIGPAVFEPRAAQRPSWLDHIDDPIVLVTTSSVGQSDAALVETAVEALRDEPVHLVVTAPTGDVDVMTRPGVTQVRFAPHSMLLEHAVCVITHGGMGVTQKALARGVPVCVVPFGRDQFEVARRVELAGCGTRLPAGKLSVGRLRTAVKTAATMTGGAARVAAGFAATGGVARGADVVESRLVARCALPEEQ

SEQ ID NO: 8541 - protein, 392 aa, Bacillus subtilis
MKKYHISMINIPAYGHVNPTLALVEKLCEKGHRVTYATTEEFAPAVQQAGGEALLYHTSLNIDPKQIREMMEKNDAPLSLLKESLSILPQLEELYKDDQPDLIIYDFVALAGKLFAEKLNVPVIKLCSSYAQNESFQLGNEDMLKKIREAEAEFKAYLEQEKLPAVSFEQLAVPEALNIVFMPKSFQIQHETFDDRFCFVGPSLGERKEKESLLIDKDDRPLMLISLGTAFNTWPEFYKMCIKAFRDSSWQVIMSVGKTIDPESLEDIPANFTIRQSVPQLEVLEKADLFISHGGMNSTMEAMNAGVPLVVIPQMYEQELTANRVDELGLGVYLPKEEVTVSSLQEAVQAVSSDQELLSRVKNMQKDVKEAGGAERAAAEIEAFMKKSAVPQ

SEQ ID NO: 8542 - protein, 394 aa, Bacillus amyloliquefaciens
MRKTHIAIINVAAHGHVNPTLPVAEELVNRGYKVTFATTEEFEASVAKTGAIPVLYRTSIKADPKTIKERVNKSDAFVMFLEEAVEVLPQLEELYKDDLPDIVLFDFLALAGKLFADNGGIPAVKFCPSYAMNEYFQLGRDEETMEAAKQAIEEYQEKIENEQVKRMTMEEFFMPEKLNIVFMPRAFQPKQETFDERFCFAGPSLGERTNTGSLEIDAADDRPLMLISLGTAFNAWPEFYRMCIDAFRDSDWRVIMSVGITIDPESFSDVPDHFIIRQHVPQLDVLEKAKLFVSHGGMNSTMEAMNAGVPLVVVPQMHEQEVTAKRVDELGLGVHLPPKEVTVARLQKDVQNVYGDKNILSRVKSMQQKIKETGGPKQAVCAIEEFLKTASVEN

SEQ ID NO: 8543 - protein, 402 aa, Tengunoibacter tsumagoiensis
MATYAFFNVPAWGHVNPTLAIVQELVARGHAVSYYLPEEFRATVEATGATFQPYVSRIGHAWTKGFADTEKGGGIIRTILADKETVGPQIIDRLRAERPDVIIYGYMCSWAKGVAEELAVPAISTRATYASNDHFDAFRDMRTRLQGAAILEEFSKLSGANAEHDSSPSSPQAELLRLTAVVEPLNIIVMSSIFQPLQETFDDRYLFIGTSILPRHQESDFPFDQLDRNRPLLYISLGSIMTNQPAFYKLCFEAFGDQPWQVVLPIGRHTDRAQLEPVPSNFILAPSVPQLEILPRTRLFVTHAGTNSIMESLFFGVPMVLIPQQPEQYMHALRAVELGLGVQLDKNTLTASALRQAVESVADNSSYQEQAHHVQNIVQADGGYQRAVDAIIQFTRTHAKHS

SEQ ID NO: 8544 - protein, 390 aa, Lysinibacillus acetophenoni
MSKIVFFSIPAHGHTNPTIPVVEELTKRGHEVWYYSFTEFLQKIEDAGATFIACDEYLPNISQEEIDQKAGKDFAALIEMAADTTIALDEKVCKELKEIQPDCIVTDSLCFWGKLFAIKLGIPYISSTTSFAFNKHTVKLMKQSFMEIWRMIVGMPRINKKIKLLNEHGYRVKNFVSLIENDNETDTIVYTSKEFQPMAETFSNHYAFVGPSIRQTSPIQKNHNSRKLIYISLGTVLNQNKDFYQNCIKAFANTDYEVVMSVGEKTDISSLGPIPENMIVKNRVDQIAILQKADVFITHCGMNSTNESLYFGVPMVMFPQHGEQKMVANRVSELGAGTSLKKQNPKMLATAVAEVIANPLYKENAQKLSESFRKAGGAKEAANVILNKLS

SEQ ID NO: 8545 - protein, 429 aa, Streptomyces laurentii
MTERRLTVLFVPESAYGPTNNCVGIGDVLRRRGHRVVFAAEASWKGKLTALGFEEDLVALAPPPEGEQEAGQFWKDFIRDTAPEFRKPTIEQLETWVKPVWEELVAGVRYCEPHLRRIIERVRPDVIVEDNVVCFPALLTAGTPFVRIMSCNPLELRTDDVPPVFSGHPSADRTGWAEFREAYDRSHRALWEEFNAWVVEQGAPALPELDFIHHGATNLYVYPEAADYARTLGPAWHRLDSSVRETDGTFELPAELRNGDGALIYFSLGSLGSADLGLMRRVIGVLAGTPHRYLVSKGPLHEEIELPPNMWGAEFLPQTSILPLVDLVITHGGNNTTTEALHFGKPMVLLPLFWDQYDNAQRMDELGFGVRLDTYRFTDGELKGTLERLLADDALRERLAGVGEEIRRRDGLRKAADLIEGAATPATGR

SEQ ID NO: 8546 - protein, 407 aa, Paenibacillus sp.
MNHLYTPNTGDGSQRKHIAVVNIRAHGHINPTLGIVEELVKQGHRVTYVVTEEFVSVIEATGAEARIYQSLFPANLTMKRQPMEDMAFGMDLFFNEAQQMFPQLEAIYEDDKPDLVLFDFMAWIGSVAASKWGVPSIQLCSSYPHDKQDPMYEEMMKMPEFAAHAEKVARYIHDLQIEELTMESLMFKQELSIVFMPRQFHYEGDSFDERYQFVGPCLRTEHNQTGWSPPTDDRPILYISLGTVFNDWPEFFNQCMEAFGSTSWHVVLVVGKHLATEQLQTVPDNFEVHATVPQLAVLQHAKLFISHGGMNSTMEAMLHRVPLVVIPQMQEQERTANRVATLGLGYYLKPEGVTVEKLREAVQTVAGHECMLERVKQMSQHIHAAGGTVRAVELIEQRLLMAEVVAK

SEQ ID NO: 8547 - protein, 396 aa, Unknown
  Description of Unknown: Bacillus subtilis group sequence
MEQKHIAIFNIPAHGHINPTLALTKKLVERGYRVTYPVTDEFVAAIEETGAEPLQYRSTLNINPQTIREMMKNKEDMPQAPKMFMKEVEEVLPQLEELYQHDRPDLIVYDFMAMTGKLIAEKLGVEAVRLCSTYAQNEHFQFKDLVERMQIEKVGQQVSDLKNANFSTARFEELFEPAKLNIVFMPRAFQPYGDTFDERFRFVGPSLAERKFQNNNEQLVKDDGRPVMLISLGTAFNAWSEFYSMCIDAFRDTKWQVIMSVGAAIDPESFEDIPDNFSIRQSVPQLEILKKAKLFITHGGMNSTMEALNEGVPLVVIPQMPEQEMTARRVEELGLGRHLQPEATTVQRLQEAVSQVDDNTELLNRVKDMQENIKEAGGAEKAADEIEAFFKPITVN

SEQ ID NO: 8548 - protein, 397 aa, Ktedonobacter racemifer
MAKFLFCNVPRYGQVNPTLAVVQELAVRGEQVVYCLTEDFRRAVEATGARLQPYRSTMFGFSSPSAPRGPYSSSTPARLVEESRYVLSQLRDVVRMEKPDCVIYDPASLWGYVLAQMLGVPAIQFRPGYVFNEHFQFASELWEGAAESIHPHPFEQVNNDFEALCRVYGVNAFPLQEMYARVEALNVISIPKAFQPAGETFDERFRFVGPSIVSRLTTSEFPLERINSQPALYISLGTVFNNRVDFFNTCFEAFGGSAWQVVQAIGQRINRSQLNEIPGNFMVYPFVPQLEVLQYTDIFITHGELGSIMESLYYGVPLIVVPQTSEEAITARRVEGLGLGLSLDTGELHADVLKQTVNRIASDSSFRVNTKRMQRALREGGGYHAAADAIVDFNQRR

SEQ ID NO: 8549 - protein, 390 aa, Oceanobacillus bengalensis
MSKIVFFSIPAHGHTNPTIPVVYELVQKGHEVWYYSFLEFQEKIEGAGATFIPCDEYLPKVSQEEIDRKAGKDFAALIEMVVDTTISLDEKVCADLKKSKPDCIVSDSLCFWGKLFAMKLGIPYFCSTTSFAFNQYTAKLMKPGFIEMTRMIVGMPRINKKLKLLRDHGYEVDNFVSIIQNDNDTNTVVYTSKEFQPMVETFSDKYAFVGPSIRMSSEVIEAKNDKKLIYISLGTVLNQNIKFYQNCMKAFEDKEYEVVVSVGKRIEISSLGHIPDNFVIKNEVDQIAILQKADIFITHCGMNSVNESLYYGVPMVLYPLHSEQRVVANRVSELGAGMKLKRMRTKNLAEAVETVLADSKYLKNAEKISDTFQIAGGARKAADFILSNLE

SEQ ID NO: 8550 - protein, 425 aa, Pseudomonas fulva
MSHFALVAPPYPSHFAAMQALGGELVERGHQVSFFHQPEAERWLSDSRLGFVAIGHAECPPGSLDLAMRRVADPAGPLRLRRLIKQLAHTTGMLISNLPQALRDHRVDAMICDQMEPAGGLVAEACNLPFFSVACALPINREPGLPLPVMPFGLGLDARLYEGSAQVHDWLMRPLHDTLVQACHRHGLPPRSGAHEFLSPLAQLSQTPLHLDFPRADLPKHFHAVGPLRSTPSQASPNWSFESGKPLVFASLGTLQGHRFDLFARIAKACRGLDAQLLVAHCGGLDAHQQARLRQIGATVVTDFAPQHWAVRRANVVISHGGLNTVLDTVCAGTPLLVMPIAFDQPGVAARVRHHRLGRVLSKRASASAIGQALRQLLDEAAPRDAALEAELATCGGVQRAASLIEAALRSGQPSISEKVPCPMT

SEQ ID NO: 8551 - protein, 424 aa, Cronobacter muytjensii
MSHYAVITPPLYSHVHAMQALAQELLARGHRITFIQQAEARTLLDDPRIGFYPVGEQSHPPGSLARTLRLTAHPGGPAMLSLIHDLARTTDMLCRELPDALTRLGIDGLIVDQMEAAGGIVAEALGLPFVSVACALPVNREPGLPLPVMPFRYAQTPRARKIYHAGQQVHDWLMRRHGAVIAHHAQRFGLAPRHGLHDCLSPLAQISQTLGALDFPRHSLPACFHAVGPLRPPQPTVSEPLPDAARPRVFASLGTLQGHRYGLFRTIARACRDAGAELLVAHCGGLNPAQAAKLEACGATRVTAFTDQPLALSQSHAVITHGGLNTVMDAVASATPLLVVPLAFDQPGVAARVEYCGIGRRVSRFAGRRAFTRQLQALLGDASCRTRLAAMQRALAQAGGATRAAQVTEQALQERRPVIAQARP

SEQ ID NO: 8552 - protein, 418 aa, Frankia sp.
MARYLVYCTTAPGHLFPLVPGLRALRDRGHEIHLRIGARLVDGPWADGLNVAPTDPRIDEIEVKADASGTGPAQLRRALAGLMSRGPLERADLERAVAQVDPDVILVDTNAYGAAIAARASGRPWGIVLPSLVALPGKGIPPYGLGLAPGRGPLGRLRDRVVWPLVIRQFGAAMLPPLNAMRADAALPPLTSPIDYFLEADRLLVLTGDPLEYPRSDAPEHVRFVGAQIYDPPGEAPAWLAEDGDPWVLVTTSTDYQGDERLAVAAVEALRDEPVRVVITLADAYGHVELPAAANVRVERFVPHGPVLERAAAVICHSGMGIVHKAIAAGVPVVAVPFGRDQPEVARRVVEAGAGVMLPARRLTAERLRDALRTAMSRRAGALNAARRIRASGGGESFATEAEGLAAAPRPAAARPAA

SEQ ID NO: 8553 - protein, 408 aa, Dictyobacter sp.
MKYILANVPGFGHVNPTLPVVEELVARGEEVVYYVPDTFKEAVESVGATFHPYELDLSNMVPPTGMGLGGPMSGIQIQNALPFRMIKESQRILPQVLEQLRQERPDAILYDAMCLWARIAAQVLHIPAIQLRPSYAINEHVKLFPMGQGNGAGSPIPPPFIQQIREDIAELCKQYQLPPFDLQSTLGHAESLNIVFMPRAFQPAGETFDERFVFVGPSLRPRHEKSDFPLQELAGEPVLYISLGTVFNNQLEFFKGCIDVFGNTDQKVVLSYGKRIQPAELGPLPANFIAAAYTPQLEVLAHTDVFVTHGGMNSTMESLYNGVPMVVLPQMIEQQMTARRVSELGLGVMLESSPDATQKLREAVEHVRQDASFRARAREMQRTIQQTGGYREAADAIMDYTQKTLQRA

SEQ ID NO: 8554 - protein, 431 aa, Granulicella mallensis
MARIGFLCLSATGHLNPTMALAKALQDRGHEPVFFNMIDNARKITELGLGFVPYGLTEYPEGTLKLIFEKISKLKGIEGFQYFMERMLVQAQVSFRELPQSITEAKIDALVIDQLFPGGATVAQHLGLLYASLANALAVNHEDGVPPPTLPWGYEETAAAETRNAAGWKQIAQAFTPWRECDNAQRALWDLEPYNDVLEDSFSPFAQIANQPQAFDLPRKNLPESFYYAGPLLHAAARQPLQFPWGQLDGRPLIYASMGTLQNGLDWAFRAIVAACVGLDAQLVLSLGGGVLTSTELGELPANAIVVPYAPQPEILERAALCITHAGLNTALESLTYGVPMVAIPVTNDQPGVAARIRYTQTGEVIALDQLTAEDLREQIVKVLDDPAYRERALQLKRDFASERPLVRACEIIESEVLSKIAASEADMARI

SEQ ID NO: 8555 - protein, 426 aa, Oscillatoria nigro-viridis
MTHFGIHCPVDTGHLNPMTTLGCELLRRGHRVTVFNFLDAKAKTLATGLEFQPFAEQEFPVGWFAEILSQRGKLSGLAALRHTFKAVAKTSDAILREAPMAIKKAGVEALLVDQVCIEGGTIAEFINIPFITVCSALLLNRDPNIPPICTLWQYDPTWKGRLRNQVSYQLLSLLARPIREGISEYRRKWKLPLHSHPNDYYSKLAQITQQSAELEFPRQNLPPHFHFTGPYHNPATRKPVPFPFEQLTGKPLIYASMGTIQNRLLDVFQTIASACEGLDAQLVISLGGGATPESLPPLPGNPIVVGYAPQLELLQKAALTITHAGMNTTLESLSNGVPMVAIPVANDQPGVAARIAWTGVGEVVALKELSVSKVRSAIVKVLTQESYKQRAIEMQEAIGRSGGVKRAADIIEQAVLTGKPVLASKI

SEQ ID NO: 8556 - protein, 389 aa, Eisenbergiella sp.
MGRIAFFNIYAYGHTNPTLEVVRELAGRGHAIRYYSFAEFRDRIEAAGADCVCCDEYMPPVPADIDKKVGKDLASLLSMTVHVTLAMEDRVMEDFRKWRPDCIVSDSICIWGKLYAGKLGIPYVCSTTTFAFNRYTAKLMKQKPGDLFRMMTGMREIKERMKELRQHGYGVDKFYELIQNDNDTDTIVYTSREFQPMADTFSSRYRFTGPSLSVPSPSRAVNGRPVIYISLGTVLNKQEGFYRSCMEALKEEDADVIMAVGMHTDISSLGSIPANFRIEPRVDQLRTLQQARVFITHCGMNSVSESLYFGVPLVLFPQQPEEGAVARRTQELGAGILLKNIYPAAVKDAVRQILEKEDYRDCARRIGDTLRKAGGAAKAADGIEAVLRR

SEQ ID NO: 8557 - protein, 398 aa, Paenibacillus curdlanolyticus
MARVLFINAGSEGHINPTLGVVQELVSRGEEVVYFCTEAFRERVEKTGALVRTFDDQKFIKAFIAGGRNYLLERVNGLLLTADVVIPAVLEQIKGETFDYIIHDAMFGCGRLLAQILKLPAISSCTSFAQTKVAFDQSLTHLYRTAPAEIVQSIEDSYQSLTAMIKQQYGVEIDSPYEVFCNPAPLTIVYTTRAFQPEGEAFDLSYKFVGPSIALRSTQESFDLAAIEGKRPIYISLGTVFNGSIGFYKLCLEAFGHTEHTVVMAIGNKVQVSDLGEVPSNFVVQSYVPQTDVLAQAKLFITHGGMNSTHEGLYYGVPLVVIPQGADQPIIAGRVVNIGAGIELQMKDLTANQLREAAEVALSTTASKEAAAHMGESFRSSGGYRQAVDEILGFASGI

SEQ ID NO: 8558 - protein, 425 aa, Trichodesmium erythraeum
MTHFGLICPALTGHLNPMLPIGQELKRRGHRVTTIGILDAEAKTLAAGLEFVAYGTEEYSKGSTAEALNHLSKLSGLAAFRYTITLLKDWTNVLLRDAPQVIKNAGVDALLIDQASLGESIGDFLDIPFITICSALVLNQDENVPHPVSNWKYNPAWWAKLRNRATWSFYQILGKPINKVVAEYRRQWNLPLYSDPNDAYSLLAQISQQPAELEFPRENLPKCFHFTGPYHYSGTREPVSFPWEQLTGKPLIYASMGTIQNRLVEVFYQITAACEGLDAQLVISLGGSATPESLPNLAGNPLVVEYAPQLEILQKATLTITHAGMNTTLECLSNAVPMVAIPIANDQPGVAARIAWAGAGVAITLKRLTVPRLRTAISQVLTQPSYKQNALRLQKAIKRAGGVTRAADIIEQAVSTGKPVLTGTI

SEQ ID NO: 8559 - protein, 425 aa, Oscillatoria nigro-viridis
MTHFGIICPAANGHLNPMTTLGSELLRRGHRVTVFNLLDAKTTTLASGLEFQALAENEFPAGSMAEGLAQLGKLSGLTAFRYTIKAFTEISAALLTEAPTAIQKAGVEALLVDQVSFEGGTIAEVLNLPFVTVCSALMVNRDHNIPPFCTPWQYNPTLANGLRNQVSYELLNLAVKPIRDVIAQYRKEWKLPLYSHPNDGYSKLAQISQQPAEFEFPRQNLPPHFHFTGPYHNPATRQPVPFPFEQLTGKPLIYASMGTIQNRLLDVFQTIASACEGLDAQLVISLGGGATPESLPPLPGNPIVVGYAPQLELLQKAALTITHAGMNTTLESLSNGVPMVAIPVANDQPGVAARIAWTGVGEVVPLKELSVSKVRSAIGKVLTQESYKQRAIEMQGAIGRSGGTKRAADIIEQAVLTGKPVLAGK

SEQ ID NO: 8560 - protein, 400 aa, Tengunoibacter tsumagoiensis
MKKYLFCAPPRYGHVNPTLAIIKTLVAQGAEVVYFCTEMFAGIVQSAGATFRPYLSTNLELATDPTASLESSDPIINECFYVFPQIVELARLEHADCIVYDEICLWGRMLAETLHLPAIKYMTTYARNEHFSYQTYANKFRNMYFPATLVASDVRKGLERFCATYNITPSITYENIFLHAEPLNIVFMPRAFHPLEETFDQERFKFVGPPIRTEDSPTNFPVDKLSNQPVIYASRGTVYNTIAGIIDIFLNAFGHREQQLVVALGPHIDPRVFGPLPENVLLHAQIPQLTVLRHTDIFITHGGMNSTMEALANGVPMVVFPHSGEESATAYRIQELKLGIAIDHNSMTVHTLRTAVETIQNDPEYRLNARRMQHILQQTTAVQDAVQEITAYGQKTVAHT

SEQ ID NO: 8561 - protein, 394 aa, Actinopolyspora sp.
MSSHVAFFNFPVIGHLTPSLGVVEELVRRGNRVTSTVTDYFVPVVEAAGAEAVRYRSEFGEYYTSPFTQEAISGEGLRTLNEATSALEQVEDFYRQNRPDVLVYDFMAWGARFLASRLEIPAVRIYPSYAANEHFSIQEKFPMAEFTDTEVVELIDQLEELLPSMGMPEMMAMDFFTQQEKLGIVLLPREFYYEGDTFDDSFVFAGPCLGDRSFQGGWSPSSRDDPVLLISLGTAATGWAEFFRMCVQAFVGTEWNVVMAVGDHIDAADLAPLPGNFEVRRHVPQLDVLARADLFITHGGMGSTMESLYYGVPQVVIPQMSEQTANAMRVEELGLGKHLPRDETTVESLREAAATVSEDPSVGGRLRTMRQAVRALDGPRIAADAVENFMKGAR

SEQ ID NO: 8562 - protein, 419 aa, Dictyobacter alpinus
MSTYLCFNIPQHGNVNPTLAIVQGLITRGEQATYYLTPEFRDPIEATGALFRSYTSSLDFNAMIAAMGSQSSTERYLTLSENILQECRALLPHILNDLQGLRPDGIIYGQAALWGRLLAQIMHVPAISVRSSYAINQYFQLFAPSPPTLEPEKAEQNRQRRDSINDQLNSLCREYHITPFDFTDIFSYAEPLTLVTMPRTFQYAGNSFDNRFKFVGPCILPRKDNTHFPLEHLGNHPLLYISLGTSFNNRPKFYQVCLNAFANTPWQVVMATGTQVTRAELGPIPENFIVQPYVPQLEILARTSIFINHGGMNSTMEALSFGVPLISVPQIQEHELTARRVVELGLGMELGPELVTAESLQMAVANIAHQPEIRMRTRQMQHIIAETGGVHAAVDAILQYLHTRQAYRHVTSFAPKSGF

SEQ ID NO: 8563 - protein, 430 aa, Gloeothece verrucosa
MAHFGLICPAAPSHLNTITTLGYELKQRGHRVTLLGVEYAKQKALAMGLEFQETGKTDFPEGSTQKIISKLSNLHGIKALRYSFAIGVKAARTCLEDAPKAAQTAGIEAMLVDQCAPEGGTVADYLGIPFVTICNGVMTNQEIGVPPFITSWNYDPSWKGLLRNKVGYELLNYLEKSLRETINSYRKQWNLATFSNFNESYSSLAQLCHQPAEFEFPRQELPLSFHFTGPYSHKSKREPVPFPYEKLTGEPLIYVSMGTIQNGLLWIFQMIAEACAPLKVQVVIALGGGHSPDSLANLPGNPLVVGYAPQLELLKKATLVITHAGMNTTLESLTNGVPMIAIPITNDQPAVAARIAWTGTGKVLPLSQVSVQKLQQFIKQVLTEDSYKNNAIRLQQAIKDSGGVRQAADIIEQAIFTGKPVFSKNQYTYQ

SEQ ID NO: 8564 - protein, 511 aa, Actinokineospora sp.
MGGRLRDRGLRPGAHVRAHVLALPPGPPQAAPVRRRAHPGGPAPRHRRRDRRRGLRRLEGAAAGRRRGRLPDPDARRLPLRAARQPVLRVGHARPVLVAQPRVYHSHNHNERTHSVASHIAIVNFPAYGHLNPTLGLVEELVRRGHRVTCTVTDHLAPAVEAAGGEAVRYTSVFGDFYTSPFTEEALSGEGLRTLAEATSLVEQVGEFYEANRPDVVLHDFMAWGARFFAAPRGIPLVRLFPTYAGNETFNIQAKFPVAELTDPKMMEMIEQLTALLPEVGFPDTGPMDFFMKPEHKSIVFLPREFHYDSETFDDRFVFAGPCLGDRSKYQGTWTAADDKPVVLVSLGTAATGRPEFFRTAVAALGTGEHRVVLVTGDHIDAAELGELPDSVEVHHSVPQLDVLSKASLFVTHGGMNSVLESLYHGVPMVVVPQMNEQRANALRVAELGLGAHLAPEDVTTESLAAAVAAVSGDAELRARTAEFGRSVRAVDGPAVAADAVEAHIAEHAGV

SEQ ID NO: 8565 - protein, 427 aa, Leptolyngbya sp.
MRIAIIAMGSRGDVQPYIALGKGLKAVGHQVRLITHENFEELVTAYGLEFCPVKGNVQAFMEDPENRKLLESGNFLAINARTAKASQQAAVDWAEGGLAACQSMELLVAGVGGLFLSLALAEKLKIPLLQAYIFPFTPTNAFPAILFPQSIAKLGGVVNRLSHHLFRQIMWQGSRAGDELARQQVLDLPIAPFWGSYDSAQFQRYPILYGLSSSVIAKPSDWQHTHITGYWFLDEAPDWTPPPALLEFLQRGSPPVFIGFGSMVSRDPEETAELVLQAIQLTGQRALLQSGWNGLRKSDLPDTVFMVDSIPHSWLFPRVAAVVHHGGAGTTAVGLRAGIPIVVIPFFGDQPFWGQRVAELGVGTAPIPRKKLTAERLAEAIHQAVSDRAMRQRATELGAKIQAEDGVANAVAIVQELEKCGAFCNEN

SEQ ID NO: 8566 - protein, 429 aa, Chthoniobacter flavus
MSHLGLICPELSGHLNPMTTLGRELQRRGHRVTVVGRLDARRKAESAGLNFAPIGEEDFPEGSMQTTSRELGRLSGLKAVQFTAELLRRSVVSILRDAPPVVDREKIDALLVDQVSPAGGTVADLTGRPWVMVSNALALNPDPHLPPCVLPWDYQTGILGRWRNAFGDTVLKWLARPIIAEINRHRRAHRLAPLAGTFSPGSCRLQIAQQPAFFDFPRRRPAAELHYTGPWHHAASHEEIPFPWEKLDGRPLIYASMGTLQNRRQFIFETIAAACAGLDAQLVISLGSRDQDAEAAAKNFAGQPIVVSIAPQLALLQKATLTITHAGLNTALESLSCGVPMVAIPITNDQPGVASRLAWLGAAEVVQPAKLTVPRLRAAVERVLREPGYRKVAERCRAEIQQADGLQRAADLIEGVFVETERSEYKIRM

SEQ ID NO: 8567 - protein, 449 aa, Unknown
  Description of Unknown: Candidatus Solibacter usitatus Ellin6076 sequence
MARLLFTVWPFAGHVHPALAIGHALRLRGHEVAFYTGEAVRSLLEAEGFRCFPFARVDEKRVFALASSEFPYRSSIWQQLRYAKQLQANFREWLLDTVPQQVEDLDTILTHWRPDVLICDLAFWSPILVLGETRGIPVAVLSVLAACLLPGPDAPAWGQGAPRPRNRIMRLRSTMKRKLLQWLSAGFLAQANGIRRRYGLPALRCSVTEFAGRMPLYLVPSMREYDYDRRDLPPSVHYVGPCLWDKPSAAPPPDWLLRLPAGRPLIYATEATIGTGEPFLLQAAARAFRNLPVDVVMTTGAQRNPAGLKLADSAPNVRVESYVPQSDLLPRTAVMVTLGGSGGVLAALKAGVPLVVVPTEWDRPENAQRVVEAGAGIRIPPNRCTPERLRSAVERILREPSYRANAQRLAAVSAHYSGPDRASELLEGLCTTAAAMPGSYGGNYRCHGF

SEQ ID NO: 8568 - protein, 299 aa, Bacillus stratosphericus
TLSQQHSFDLVYFDMFGAGELVRDYLQIPGIGSNPSFVLQEAHFDTPLYRKDEKAAHLLEEIHERFGVQPKHLMQFMKNRGELNMVYTSEYFQPSVDALDDSFVFIGPSFLKRADQHDFPLEALEREKVVFISMGTVLGDTEAFFNMCIDAFADFDGKVILATGEKIDMSLLKEAPSHFLIEPYVPQLEVLELTDVFVTHGGMNSVNEGIHYHVPMVVIPVDKDQPMVAKRLTDLSAARALDKDELTAKQLRDTVESVLGSDTYRAGIEKIEESFQTAGGTEKALRVIDQFMQAKQTQS

SEQ ID NO: 8569 - protein, 392 aa, Streptomyces glebosus
MAKHLLFVALFGHGHVNPTLPLVEELVRRGHRVDYATSAEHSEAVTKAGARWVELKLQSPEILTPPRQFGLEEIRVFLRGMFAEMCTQYPVLRDYCAAESPDAICYDGMNWPARVVAEDLGLPAVRLIPNFASNEAFSLFDDVMNDNGDENPVLALLAADCAEFSAEHGVTLAPESVLDGTEERNLVFIPREFQPAGDTFDERFHFVGPSLGSREHAEPWSPADPEAPVLFISLGTVFNDRPEFYRTCIDAFRDGPYQVAMAIGDLDRAALGEIPPTFDVRPYFPQPAVLRHADAFVSHAGMNSTMEALYYGVGLVTIPQMPEQAANAGRAQELGLGVQLDPATVTAESLRTAVTHVASDPAVRSNLDRMRTVVKGSGGAVRGADVIEEYLH

SEQ ID NO: 8570 - protein, 357 aa, Unknown
  Description of Unknown: Pseudonocardiaceae bacterium YIM PH 21723 sequence
MHIGFVCGPGIGHLTPVLAVARELVARGHRVTVPSTVEHRELIGAAGVAAPIYRSPLKESFRPEVRYSTQELLTAFRREAEQLLPRFEEIFAGDRPDLLVYDQATMVGWLLADRWGVPHVRTHPSVASNGHFTLWGRSFTAEILEFTEHQPDLGLVFCTRSFQPFGETFDERYRFVGPCIGERPATGWRPERTDRPLLYVSFGSLFNDRPEFYRLVVEAFRDQPWQVVMAVGKADVGVTAPNVELHEFAPQLEILRHASVFITHAGMGGVQEGLSAGVPLLGVPQIEEQELNADRIAELGLGRRLRPEDLTVHGLRDAVTGVLADVEMRDRLNDMRADIESAGGTRRAADILEAAVG

SEQ ID NO: 8571 - protein, 397 aa, Bacillus swezeyi
MEQKHIAILNIPAHGHINPTLALTANLVNRGYRVTYPVTDEFVKAIEETGAEPLRYHSTLNMDPRQIRELMKNKKDMSQAPMMFMKEVQEVMPQFEEMYENDKPDLIIFDFMAMTGKMLAEKLGIKAVRLCSTYAQNDHFQFSDFSKEDFQIELTSEQEAALKNANLPSFSFEDAFKPAKLNIVFMPRAFQPYGDTFDERFSFVGPSLAKRKFQEKDTELLNDNGRPVMLISLGTAFNAWPEFYQMCIEAFRGTKWQVVMAVGTTIDPDRFEDIPENFSIHQHVPQLEILEKAQLFITHGGMNSTMEGLNAGVPLVAVPQMPEQEITARRVEELGLGTHLEPEETTVASLREAVCQVDGDLEVIKRVKDMQKNIKDAGGAERAADEIEAFLALAAVK

SEQ ID NO: 8572 - protein, 341 aa, Pseudomonas sp.
IRDLCDTTRMLCAELPSALAVRQIEALLCDQMEAAGGMVAEGLGLPYVSVACALPVNREPQLPLPVMPFAYATDERSQHVFEGSRKVYDWLMSPLSKVLRDASRRLAIEPRDGLHECLSPYAQISQTLPGFDFPRQQPPANFHAVGPLRAPQTEQPGEWPIDPARPFIFASLGTLQGSRFDMFQRIATASRQLNAQLLVAHCGGLDARQEQRLIQAGATWVTDFAPQQWALRHADAVVTHGGLNTVMDAIVARTPMLVMPIAFDQPGVASRVTHAGIGLQLRRGAGAVQIRERLTQLRGLSVEPFERLATELANAGGTSRAADIVEAVVRTGEPVLAGLMP

SEQ ID NO: 8573 - protein, 391 aa, Paenibacillus sp.
MSKIVFFSIPAHGHTNPTIPVVREIVNRGHEVWYYSFLEFQEKIQASGASFIACDEYLPKLSPEELDRKAGKDFAALIEMVADTTIALDAKVCKELQELQPDCIVSDSLCFWGKLFASKLKIPYICSTTTFAFNQHTAKLMKRSFRELLKMAFGMPRINKKIQMLRNHGYDVRSFISIVQNDNDTDTIVYTSKEFQPMADTFSERYAFVGPSIRTLSPQENNKKDRQLIYISLGTVLNKNREFYDNCINAFAQSNYTIVISVGEKTDIKSLGIIPENFMVRNTVDQISVLQTADAFITHSGMNSVSESLYFGVPMVLFPQHSEQKMVANRVAELGAGVLLKGKKRADLAASVTEVLTNVKYEENAKKLSKSLRNAGGAVEAANVILKQTQE

SEQ ID NO: 8574 - protein, 392 aa, Unknown
  Description of Unknown: Clostridiales bacterium Marseille- P2846 sequence
MSKIAFFCIPAHGHTNPTLEVVRELTRRGHDVLYFSYQAFREKIEAAGATFIACDPYDVEMNLRPEDAARVGKDMGFSIKLLVQTTLALDGMVCETLKKWRPDCVIADSMAAWGKFAALKLGIPFISSTTTFAFNRYSARIMKPSLSQVFSMIAAMPSVRRDLKLLQSHGYPVKNLLSLIQNDDETDTLVYTSKAFQPRSDTFSEHYAFVGPSLHVPQPFKRDSRKTIYISMGTVNNRMPDFYQNCVEAFSDGTYRALLSVGDGTDIAALGPLPESVSVYGHVEQTAVLQSADAFLSHCGMNSVSESLYFGVPLVLFPQTAEQSGVANRTADLGAGLFLKENRPEAIRRAVDTLLGDAAYTQSARRIADSFKRAGGANAAADFVESRLRKRA

SEQ ID NO: 8575 - protein, 392 aa, Unknown
  Description of Unknown: Ruminococcaceae bacterium AF10-16 sequence
MSKIVFFCIPAYGHTNPTLGVVRELTARGHEVRYYSYEPMRTLIEAAGAQFVACDPYDCEQHLTPADGARVGKDIAFSTHILVETTLALDEMVCADMRAYAPDCIVADSMAVWGKAVAKKLGIPFISSTTTFAFNRYSAKVMKQSGGQMLKMMLAMPKINRDLQRLRDRGYPIKNILDIIQNDDWTDTIVYTSPEFQPCANTFSDKYAFVGPSIRPATETVEKAHDVLIYISMGTVNNDLLPFYRACIAAFADSPYQVILSTGEQIDRSALGTLPDNITALPHVDQIAVLQKADVFLSHCGMNSASESLYFGVPLVLFPQTNEQGGVAARVAELGAGLKLEKADAASIRTAVDAVLQTPSYRANAQNIRESFLRCGGAKAAVDRILSVADRK

SEQ ID NO: 8576 - protein, 393 aa, Bacillus sp.
MSKIVFFSIPAHGHTNPTIPVVTELVNRGHQVWYYSFSEFQEKIESAGATYIACDKFLPQLSQKELARKAGKDFAALIEMVADTTIALDEKVCKELKAIHPDCIVFDSLCLWGKLFAQKLGIPYICSTTSFSFNQHTTKLMKPSFLELWRMVVGMPRINKKIHLLKNHSYEVENFVSIVQNDNETDTIVYTSKEFQPMAHTFSERYAFVGPSVRQSSPVQSAKKDKKVVYISLGTVLNQNYDFYQNCIKAFAKTNYDIVMSVGEKTEISSLGNIPENFTVKNSVDQISILQTADVFITHCGMNSVNESLYFGVPMVLFPQHSEQKLVADRVAELGAGLKLKRTKPNYLATAVAEVLTNWTYKGNAQKLSESFRNAGGAVEAANVILTKIGEKS

SEQ ID NO: 8577 - protein, 394 aa, Bacillus nakamurai
MKKNHIAIINVAAHGHVNPTLPVAEELVKRGHRVTYATTEDFAQAVLKTGATPVLYRTSIKPDPKTIKEQVNKSDAFVMFLKEAADVLPQLEELYKDDLPDAVLFDFLALSGRLFADKWGIPAVKFCPSYGINEHFQIKKDKDIIEAAKQAIEEFQEEAENEQVKHMTMEEFFKPEKLNIVFMPRAFQPKQETFDDSFCFVGPSLGERTNTGSLELEEADDRPLMLISLGTAFNAWPEFYQMCIDAFRDSDWRVVMSVGTSIDPEGFTDVPDHFIIRQHVPQLDVLEKAKLFVSHGGMNSTMEAMNAGVPLVVVPQMQEQEITATRVDELGLGVHLPPKEVSVSRLQKDVQKVYQDKNILSRVKNMQQKIEETGGAKQAAAAIEDFIKEAVVEN

SEQ ID NO: 8578 - protein, 407 aa, Ktedonobacter racemifer
MATVVFLSLPAQGHINPTLPLVTELVRHGEQVIYYTSDEFQAAIELAGATYRSYGKAFPLDLVHNQYKFEHHPLLAVETLLETSLWVLAHLQAEIQASCPDYLIYDACCLWGNFLAQLLHLPAIASLSTMAANQRILNEIHASIHENVTQTPSREYEYLQRCLILLAILCDHYHLKPPQDIFAIFHNYGDLTLVYTSRAFQLDADSFDEGRFKFVGPLIASRSQAPPFPFTNLSRQPLIYISLGTMYSDRAAFFHTCLEALAESPWQIVMATGHNLDPASLEPLPSNIIMERFVPQLEVLQHSALFITHGGMNSVSEALYYHVPMVVIPQSMDQPWNAARVAELGAGKVLTNAQVTPESLHHSVEEILANPSFTRAATSIGESLRQAGGVQRAITEILAFKRARNIP

SEQ ID NO: 8579 - protein, 427 aa, Calothrix sp.
MTHFGLICPSATGHLNPMTTLGYELQRRGHRVTLFGILDSQAKTLAAGLEFRAIGESAFPKGTMTQLFTELGKLSGLAAVKYTITCIQKTGAMFLDEAPAVIKEAGVQALLVDQVSPEGGTVAEFLDIPFISVCNAMMINRDFSVPPFNTSWSYSRAWWAKVRYRAGYELLNRIGQPIRETINQYRREWKLPPYSDPNDYYSQLAQISQQPAEFEFPRQNLPKSFHFTGPYHNPASRESIPFPFEKLTGKPLIYASMGTVQNRLLPVFQSIAEACYGLDAQLVISLGGSASPEVLQELPGNPLVVSYAPQLELLQKATLTITHAGLNTTLESLSNGIPMVAIPITNDQPGVAARLTWIGAGKMVSLSRLSVPRLRDAIQKVLTEDSYKKNALRLQEAIQATNGVSRAADIVEQVVSTGKPVLAQTKQ

SEQ ID NO: 8580 - protein, 436 aa, Tetranychus urticae
MDDANKPLKILMTSMIDFGHLNSCLGIGYLLVKRGHQVYLAHFPKNKSIIEKQGIKFISLYDYADEGAQLSDAVPRSSSNFKPRFERSLKMDPLEALKEQIATGSINTGFVNILERYKAENVVMHKIVDQLKPDICLCDYLYPLPWMFTVDCPVIPVKSTNPVGLYRGPPSNSGYSVKDSTELWDEFKALNEKVNQPILDKVNEIFQLFNVQFIHRDHVKYFGIYIYPGPLDYHELAPPKEKWVRLDSALREHDATEFELPEKLKDKPGKLIYISMGTLISAVTELLTMILTPLANSPHRFIVSTGPNGDSIKLHDNMWGDKFVDQVALLPKVDLFITHGGSNSLIEGLTAGKPLIVIPQFGDQPDNAQRVADLGLGVRLNLHEFSGEKLLKAIEDVLNNKEIHLNVARVSEELKKSGSKEKVVTLIEKLARNKRL

SEQ ID NO: 8581 - protein, 423 aa, Gloeobacter violaceus
MIKRIVLVTYGSLGDLHPFLAVALGLQGRGHDVVLATSQNYRARVEEEGIAFQPVPPDLGLLEDDPQAIRRSMDLRTGTEFVVRSLFLPYLEQSYESLLAVCDGTDLIVGHPLAFAVPIVAQKLGIRWLSVGLQPMGFLSCYDPPVLPIAPWLAQLRFLGPLPYAVLFRLLEGVADGWLAPIENLRRRAGLPKSERHPLMHPFSPHGTLAWFSRVLAEPQPDWPPRTQVTGFPFYDRAEPGQSGLDAGLAQFLDAGEPPVVFTLGSAAVWVAGNFYQESAAAAEALQLRAVLLVGRNPKIDFPDLASSRIHVGEYAPYSELFGRSLAVVHQGGIGTTAQVLRAGRPMVVVPFSHDQPDNAERARRLGVARVIARRSYEGKRVARTLGELVQDQSAFKKATAVASRIQSEDGVAGACNAIEALL

SEQ ID NO: 8582 - protein, 416 aa, Frankia sp.
MARYLVYCTTAPGHLFPLVPGLRALRDRGHEVHLRIGAKLVDGPWSQGLHVAPTDPRIDEIDVREPTTGSGAARLRKAIAGLMSRGPLERADLDRAIDETDPDVILVDTNAYGAAVAARASGRPWGIALPTLIALPGKGIPPYGMGLAPASGPLGRLRDRVLWPLLIRQFGAAMLPPLNELRAGAGLAPLTSPLDYLLEADQVLVLTGEPLEYPRSDVPAHIRFVGAQIYDPPGETPAWLEEPGDPWVLVTTSTEYQGDERLALAAAEALRDEPVRVLITLADAFEHVDLPAAPNIRVERFVSHGPVLERAAAVVCHSGMGIVQKAVAAGVPVVAVPFGRDQPEVARRVVEAGAGVLLPARRLTADRLRAAVATARGQRAGALQASRRLLRQAGGEVFAVAAEELLAGTAVPSQAV

SEQ ID NO: 8583 - protein, 417 aa, Paenibacillus curdlanolyticus
MTRGIYFGVDLHGHVNPTLGLIRELTSRGEEILYYSGEPFRERIEAAGAAFTTYKEPLGFGTHDAGGIETFLVTADFILSRSQKIVSSLLEEVQAWAPDYIVHDAFCYWGKELALQLGVPGISVFANFAYIDEMADVDPEFFMEYVLRAGNDPVYAKNKGKTDVYRKLEAKLSKIIAMKYGVHTTSIINDIFCGKEKLNLAPTSREFQLYGQAFDDSYVFTGYAIEPRTEPDDFPFEWLDGRPLIYIALGTIFNDAEHIYTKCIEAFGDQEVQVAMSIGHQVPVERLGQLPDNVIVRPHMPQLALLSRAAAFVTHGGSNSIHESLCSEVPMVVVPQSFDQFMGAIAVEKAGTGIFLQGEDWQPAEVADAVRRVRTEPAYQEACGRIHRSLDEAGGPARAVDAIFAHVAAERGKALQP

SEQ ID NO: 8584 - protein, 520 aa, Drosophila erecta
MWPNLLLMCLLPGYLEGARILAVFPLPSPSHYFFALPYLKSLASLGHEITSVSPYPQREPSQNIHDIPVLEVLENFNEILRIASTPRGTWQKSDFINEYVLNLTKTVLNNEGVRCNILGPEKPHFDLVVMDLWRIDVLSGLAAYFDAPIIGLASYGTDWKIDELMGNISPISYLQSPSPRFYDLGAYGQRLSQFVERTLSYINYKWRHVRKEEALYRQYFPSTAKWKSLSEISRNFALVLVNHHFTLGPPRPYVPNMIEVGGLHVNPDPEALPAELDHFIQGAGESGVIYFSLGTNVRSKSLSEDRRKVLLETFASLPQRILWKFEDEQLPGKPSNVFISKWFSQQAILAHPNVKLFITHGGLLSTIESIHHGKPMLGLPCLFDQFRNMGHVKQMGLGLVLNIKEMTSEDFNSTIIRLLTNKSFEETARITAARYRDQPMKPLEKAIWWTEYVLRHKGAAHMQVAGKDLDFVRYHSLDVLGTFLIGALGFLGTFTFFIVMTLRKCPLLKKYKYEAIKKIQ

SEQ ID NO: 8585 - protein, 423 aa, Cronobacter condimenti
MSHYAVITPPLYSHVHAMQALAQALIARGHRITFIQQAEARTLLDDPRIGFYPVGEASHPPGSLARTLRLTAHPGGPAILSLIHDLALTTDMLCRELPDALSRLGVDGLIVDQMEAAGGLVAEALGLPFVSVACALPVNREPGLPLPVMPFRYAPTPRARKIYQTSQQIHDWLMGRHGAVIAHHAQRFGLPPRHGLHDCLSPLAQISQTLSMLDFPRSAPPACFHAVGPLRPPHPAPEPALPSSRPRIFASLGTLQGHRYGLFRTIAKACREADAELLIAHCGGLNATQVAKLETCGSTRVTGFTDQPLALSQSQAVITHGGLNTVMDAVASATPLLVVPLAFDQPGVAARVEHCGIGRRVSRFAGRRAFTQKLQALLSDESCRSRLIAMQRALTQAGGVQRAAHITEQALSARRPVLAQAAS

SEQ ID NO: 8586 - protein, 396 aa, Bacillus sp.
MGQKHIAIFNIPAHGHINPTLALTASLVKRGYRVTYPVTDEFVKAVEETGAEPLNYRSTLNIDPQQIRELMKNKKDMTQAPMMFMKEMEEVLPQLEALYENDKPDLILFDFMAMAGKMLAEKFGIEAVRLCSTYAQNEHFSFKSMSEEFKIELTPEQEAALKNANLPSFNFEEMFEPAKLNIVFMPRAFQPYGETFDERFSFVGPSLAKRKFQEKDTPVISDSGRPVMLISLGTAFNAWPEFYHMCIEAFRDTKWQVIMAVGTTIDPESFDDIPDNFSIHQRVPQLEILKKAELFITHGGMNSTMEGLNAGVPLVAVPQMPEQEITARRVEELGLGKHLQPEDTTVASLREAVSQTDGNLDVLKRVKDMQEHIKQAGGAEKAADEIESFLAPAGVK

SEQ ID NO: 8587 - protein, 426 aa, Cyanothece sp.
MSHIGLLCPTASGHLNPMTTLGYELKRRGHRVTLVGTLDSQAKVLAAGLEFRAIGEEDFPAGSTAASLSRLGQLSGLAAFRYTADLFKKATAMFLQEAPAALQTAGVELLLIDQTIFGGSTVAQHLDLPFISVCCALMLNRDADVPPLNTSWSYQPNWWGRLRNQAGYGLITRLTRPIAAILTAYRHQWNLPPLNHPNEAYSQLAQLCQQPAEFEYPRPALPPCFHFTGPYSNPASREPAAFPFEQLTGQPLIYASLGTVQNRLLGTFETIAAACQDFKVQLVIALGGGCEPESLPDLPGSPLVVGYAPQLELLPKARLTITHAGMNTTLEALSNGVPLVAIPIANDQPGVAARIKWTGTGEFVPLQRLTVAKLRWAIEQVLSEPSYQQNALRLREAIQRAGGVKKAADIVEQVIATGKPVIRQSQ

SEQ ID NO: 8588 - protein, 403 aa, Paenibacillus sp.
MKKTHIAMINIPAFGHVNPTLAVVSELVQRGYKVTYPATEKFILVVKETGASVLPYHSATTDLLDQLNHVKEINEVMSIHSENLPMRFLEEAISTYYQLEQMYADDLPDLILFDFMALAGKLFAAKHGIEAVRLYSSYANNEHVSTLHDVSDEIKNELASKLNAFSEKEGITGVSFMELFTPEKLNITFMPRAFQLKGELFDERFLFVGPSIGKRSYDESLPIDGNNDRPVMLISLGTIFNPWPEFYKMCIEAFRDSNWQVVMSTGSKISPESLGEIPDNFIVRHQVPQLEILPHTRLFITHGGMNSTMEALSCGVPLVVIPQMFEQEITARRVSELGLGHHFLPDEVTVQALQTSVQEVSEDEQLKRRVYDMQKNIQEAGGAKKAADAIEKLLSVSNMKARV

SEQ ID NO: 8589 - protein, 397 aa, Evtepia gabavorous
MSKLVFFNIPAYGHTNPTLGVVRELVARGNQVWYYSFAPFQKVIQEAGATFVPCDDAALGMTPSPEDSARVGKDLAFSIDLIVRATLALDEKICRDMERIAPDGIVADSMAFWGKLAAQKLGIPFLSSTTTFAFNRASAKVMGQGMGNLFSMVRAVPKIHRSLRRLRAYGYPVKNVFSILENDNATHTIVYTSRYFQPAAETFSPRYVFVGPSLRPIRQPLAPSPQKTVYISLGTVNNQNLPFYRSCLTALGETPYRVVMAVGRESMRHALGPLPANVQAEAMVDQIGVLAAADVFLTHCGMNSVSEALFFDVPLVCCPQTQEQRGVANRVLALGAGLLLPDDSPQAIAQAIGIALSDPSYRAHAATIAQSFRESGGAPQAAETILQVIAQDRATGT

SEQ ID NO: 8590 - protein, 400 aa, Unknown
  Description of Unknown: Actinobacteria bacterium OK006 sequence
MTTRPAHIAMFSIAAHGHVNPSIEVIRELVARGHRVTYAIPPAFAEKAAETGAEPRLWHSTLPTDDDPEAWGTELIDNIEPFLTDALQAEPQLAAAYEGDEPDLVLYDITAYPARVLAHRWGVPIVQLSPNLVAWEGYDEEVGKPLFEPLKQTPRGKAFYDTFARWIAENGMDLSVEDFMGRPDRCLVLIPKALQPNADRVDEKRYTFVGACQGERAAQGDWRRPADAEKVLLVSLGSSFTKQPAFYRACVEAFGGLPGWHVVLQIGRFVDPAELGEMPGNVEVHPWVPQLAILRQADAFITHAGAGGSQEGLATGTPMVAVPQAVDQFGNADMLQALGVARHLPMTEATAETLRETVLALVEDPEVARRLAVIREEMAGEGGTGRAADLIEAELRLRQA

SEQ ID NO: 8591 - protein, 394 aa, Bhargavaea ginsengi
MSRIVFFSLPAHGHTNPTLPVVRELTERGHEVWYYSFREFREKIIAAGAKFIGCDQFLPQATDKEISKKAGKDFAALIEMTVDTTLAMQEKVLKELSSAKPDCIVSDSMSVWGKLYAQKLDIPYICSTTTFAFNQHTAKLMKPGFKETLKMIIGMGRIRGKIKELQQAGYEVNSFTSLIGNDNDTETIVFTTREFQPLAETFSDRFAFVGPSIAGKDQNTVEKEKSGTLVYVSLGTVLTNSHFHKNCISALTGSKGEVVMSVGEKTDIGQFGTAPDNIRIKNTVDQIAVLGRADVFITHSGMNSVSESLYQGVPMVLYPTHSEQKLAAQRVAELGAGIILKNDRPQTIREAVHQILEDPQFRRNAAKISGLFRNAGGASAAADVILSRINREEP

SEQ ID NO: 8592 - protein, 252 aa, Bacillus amyloliquefaciens
MPFKPDRECEELLAEMKDKYGVAPDSLVQFMNNTGELNVVYTSRYFQPESETFGDEYLFIGPSFPKRKGDTAFPIDSLKNEKVIYISMGTVLGNTEAFFNLCIDAFSDFEGKVVIAAGEKADLSKIKQAPENFIIAPYVPQLEVLEQADVFVTHGGMNSVNEGIHYQVPLVVIPHDKDQPMVAGRLTELNAGFTVQKDEVSAEKLKLAAEEVLHNGKYKQGIQAINESFKECMDMKDVLARIDRFIETKNAH

SEQ ID NO: 8593 - protein, 397 aa, Streptomyces pratensis
MTTPPRAHIAMFSIAAHGHVNPSLEVIRELVGRGHRVSYAVPASFADTVAATGAEPVVYTSTLPTRQEDWGSELIDHIEPFLDDAVQALPQLADAFAGDEPDLVLHDITAYPARVLAHRWGVPAVQLWPNMVPWEGYAEEVGEPRNAEVRRTERGRAYFERFADWLAVNGLGDLSSGDFVARPRRGLVLIPEALQPNADRVDHARFTFVGACQGERADQGEWKRPADAEKVLLVSLGSSFTGGPAFYRECVEAFGGLPGWHVVLQIGAQVDPADLGHVPPNIEVHPWVPQLSVLKQADAFITHAGAGGSQEGLATGTPMVAVPQAVDQFGNADMLQSLGVARHLPKEEADAASLRAAVLALADDPDVAARLTLIRGRMAEEGGTGRAADLIEAELPA

SEQ ID NO: 8594 - protein, 392 aa, Bacillus cabrialesii
MKKHHISMINIPAYGHVNPTLALVEKLCEKGHRVTYATTEEFAPAVQKAGGEALIYHTSLNIDPKQIRERIEKNETTLNLLKESLSILPQLEELYQDDQPDMVIYDFIALAGKLFADKLNVPVVKLCSSYAQNESFQFGSEEMLKKIREAEAEFKAYLEQEQLPAVSFEQLAVPEALNIVFMPKSFQIQNETFDDRFCFVGPSLGKRTAQESLSIEKDDRPVMLISLGTAFNAWPEFYKMCIDAFRESSWQVIMSVGKTIDPESLGDIPDHFTIRQSVPQLEVLEKADLFISHGGMNSTMEAMNAGVPLVVIPQMYEQELTAKRVDDLGLGVYLPTEEVTVSRLQEAVQAVSGDREVLSRVKNMQKDVKEAGGAERAAAAIEAFMKKSAVPQ

SEQ ID NO: 8595 - protein, 390 aa, Unknown
  Description of Unknown: Lachnospiraceae bacterium TF09-5 sequence
MSRIAFFNIPAYGHTNPTLEVVRELVKRGYEVHYYSFREFRDRIEDTGAACICCDEYMPPAPADIDKKVGRDLASLISMTVHVTLAMEERILKEFGEWKPDCIVSDSICIWGKLYAKRLGIPYVCSTTTFAFNRYTAKLMKQKPGEIFRMMAGMSEINARMEELQQHGYQADKFYELLQNDNDTDTIVYTSPEFQPMADTFSSRYRFTGPSLAVPVSAAAERRRPLVYVSLGTVLNKKDSFYRNCMEALKGENMDVIMVVGSRTDIPSLGDIPSNFTISPRVDQLQVLQEASVFITHCGMNSVSESLYFGVPLVLFPQQPEEGAVARRVQELGAGIFLKSTRPAVLKRTVTYLLENQSCRENAGKIGAGLKRAGGALKAADTIEEIIEKK

SEQ ID NO: 8596 - protein, 393 aa, Bacillus atrophaeus
MKQHHITIINIPAYGHVNPTLALVEKLCEKGHRVTYATTEEFAPAVQQAGARPLLYETTISVDPQQIKELMEKNETPLMFLKESLGILPQLEELYKEDQPDLIVYDFIALAGKLLADKLQVPAVRLCSSYAQNESFQMGTEEMLKQVKEAEAEFQAFLEQENLPAVSFEQLAIPEAFNIVFMPRSFQIKNETFDDRFCFIGPSLGKRSEQERLLLKEKGDRPLMLISLGTAFNAWPEFYQMCMEAFGGAKWHVIMSVGKSIEPDSLGDIPDNFTVRQSVPQLDVLAEADVFISHGGMNSTMEAMNEGVPLVVIPQMHEQELTAQRVEELGLGIYLPKEEVSVPRLQQAIGNIFSDKEIHSRVKDMQKDVKEAGGAEQGAAEIEAFMKKSVVPQ

SEQ ID NO: 8597 - protein, 389 aa, Eisenbergiella massiliensis
MSKIVFFCIPAYGHTNPTIEVVRELVKRGNQVHYYSFYEFRSRIEETGAVCIPCDDFMPPAPKDIDKKVGKDLSSLVDMTVDVTLAMEDKVLGELRAWKPDCIVSDSICIWGKLYAKKLNVPFVCSTTTFAFNQQTARLMKQSLSELLRMLSGMPRINARLRQLRRHGYEIRQFYELLQNDNDTETIVYTSKEFQPMSETFSDKFTFTGPSIAVPKPSGHKKSRPLVYISLGTVLNRQEDFYISCMKALKTEAVDVIMSVGGRTDISGLGVIPDNFQVIPRVNQLEVLQEADVFLTHCGMNSVSESLYFGVPMVLFPQQPEEGAVARRVQEVGAGIPLPGREASVIRESILQVLKNARFRVAAGGIGESFRKAGGAQKAADVIEKISSK

SEQ ID NO: 8598 - protein, 393 aa, Streptomyces sp.
MAHIAFFNFPAVGHVNPTLGVVEELVKRGHRVTCTATEFFVPGIKAVGATPIVYESPFGEFYRSPYNEEMMAGEGVRCLDEAIALHKQVSGYYGEDRPDVVVHDFMAWGARFYAAEHGLPTVRLFPSYGVSETFNIAEKFPWSAPDDPKILEMVQRLTALLPTFGLPGDMGAFVTDVAKTGIIFLPREFHYEGETFDERFVFAGPSIKDRSTFQGSWEPKSADRPVLLISLGTAATGWSEFFSLALRAFGDSDWDVVMAVGDHIDPAELGEVPANFEIRRHVPQLDVLRHARVFLTHAGMNSTMESLYHGVPMVAVPQMNEQRANALRIEELGLGRHLPREEVTVESLRASVDAVAADEAVAERVRTMQEALRSVDGAAVAADAVEARLAATD

SEQ ID NO: 8599 - protein, 406 aa, Paenibacillus sophorae
MKKTHIAMINIPAYGHINPTLAVVAELVKRGYKVTYPATENFIPVVKETEVSVLPYHSDSMDLFEQLNHVKQISEAISTHSENLPMRFLEEAISTYYQLEQMYADDLPDLILFDFMALAGKLFAAKHGIDAVRLYSSYANNEHISLLPDVTDEVKNELASKLKAFSEKEGIQGVSFMELFTPEKLNIAFMPRAFQLKGDLFDEHFLFVGPSIGKRSYDESLPIEENNDRPVMLISLGTIFNPWPEFYKMCIEAFRDSGWQVVMSTGSKISPESLGDIPDNFIVRQQIPQLEILPHARLFITHGGMNSTMEALSYGVPLVVIPQMFEQEVTARRVTELGLGQHFLPDEVTVEILQKSVQEVSEDKQLKQHVYDMQKNIQEAGGAKKAAEAIEKFLNESTRHNIHVAH

SEQ ID NO: 8600 - protein, 401 aa, Dictyobacter sp.
MAKYAFFSIPAHGHVLPTLPLVAELVSRGEHVNYYMTGEHKDSIEAAGARWHDFPFFGKLSLEDEERGTNILIESLRAEQTDFIIYDFFFIWGTLFARALQIPAINIRGTYANNRHFSMQSIHQHKSHIWRGKDKDDSAKYFMPPLYAQFARIGKFLNVPLPLSDDPFDVFAGNEALNIYMMSRKFQPYAQTFDERHVFVGSSIQSRASNGDFPFEALDGRPLLYIALGTLFNHRADIFKTCLKAFAQTSWQVVLSRGRQSTIFALGPVPANFLVVNYAPQLELLKRTAIFISHGGMNSTIESIMAGVPVIYIPQIEEQAINAENAEKFGLGIALNPENVTVDQLRDAVERITNSRAYYEENIQAMRSSIQSEGGYKRAVDAILSLNARGELAPMSSSSSS

SEQ ID NO: 8601 - protein, 393 aa, Pseudobacteroides cellulosolvens
MAKVLFVNGNVHGHINPTLPVVRELVNNGEEVCYFSTMEFKQKIEAAGARFVDYGSRMYEFFQRFKPSGDHPFYTLIEFMLEMDRTAVPIVIEKTKGEAYDYIIHDSMFGAGNVLSKLLNIPAICSCTSFAMNRIPLPSHMFQPGFNPQLDNIYTKLKDTVADWGVEKLDIMDIFFKKETLNIVYTSKMFQPEWETFDDSFRFVGPSIAEREDRLDFRLEDVGNKPVIYISMGTIINQCMDFYKKSIEAFKGENCMVIMSVGNKTDIGLLGEIPDNFVVRNHVPQLEVLKSADVIICHGGLNSVSEALYYGVPVISIPQVNDQYMVSRQLVKLGAGLELKMEDITYKVLKNSVKTVLSDTSYKASSSKIGRSFVEAGGYKAAAKHILDFIKQI

SEQ ID NO: 8602 - protein, 402 aa, Bacillus sp.
MANVLVINFPGEGHINPTLAIVSELIRRGETVVSYCIEDYRKKIEVTGAEFRVFENFLSQINIMERVNEGGSPLTMLSHMIEASERIVTQIVEETKGEKYDYLIYDNHFPVGRIIANVLKLPSVSSCTTFAFNQYITFNDEQESRQVDETNPLYQSCLAGMEKWNRQYGMKCINMYDIMNHPGDITIVYTSKEYQPRSDVFDESYKFVGPSIATRKEVDSFPMEDLKDKQLIFISMGTVFNEQPELYEKCFEAFKDVEATVVLVVGKKINISQFENIPNNFKLYNYVPQLEVLQYADVFVTHGGMNSSSEALYYGVPLVVIPVTGDQPLVAKRVSEVGAGIRLNRKELTSELLRETVKKVMYDVTFKENSRKVGESLRNAGGYNRAVDEIFKMKVNSYLKLK

SEQ ID NO: 8603 - protein, 310 aa, Bacillus cereus
LYILEITKRLCKSINFDFVVYDIFGAGELVKEYLQVPGIVSSPIFLIPPVLLETLPFHPNAEIQFQPDELSEKLLYQMEHEFGVKPKNNLQFMHNKGDISLVYTSRYFQPNSDSFGENNIFIGPSIIKRKTNVKFPLELLSKKKVIYISMGTLLEGLEPFFNTCIDAFSNFEGIVVMAIGDRNDISKIKQSPDNFIITPYVPQSEILSEADVFITHGGMNSVHDAIHYNVPFVIIPHDKDQPMIAQRLTELEAAHRLLKEHVNVQTLKKAVTDVLSNEKYRHGIRKLNESFLECGGSKRAIAVIDALLNK

SEQ ID NO: 8604 - protein, 449 aa, Sphaerobacter thermophilus
MTGSSNRRTIIFFPEGAFGPTNNCIGIGKILLERGHRVVFVVEESFAGTLAARGFEERLMRLSPPPEVPEEPGQFWKDFIRDTAPHFRKNTFDQIASLTQPIWESLVDGAIYVEPRLREIFAEVQPDVIVEDNVVAFPAMLTAGVPWVRIISCNPLEIAEPDLPPALSGLPTDDRSEWERWRAEYDRCHADLYARFNAFVQENGCPPLPPGQFMYESPWLNLYLYPEEADYPRSRPLPATYHRLDSSVRDTEPPFSVPESLRGEGPLIYVSLGSLGSAEPELMNRLVDLFAGTNYRVIMSLGPQAGQIELPPNIWGEEFLPQPSILPLVDAVVTHGGNNTVTESVHFGKPMLVLPLFWDQHDNAQRVQEVGFGWRLTSYGFTDAEFHEALTDLLRDDARRARMQRIAARLQANPGTVKAADLIERVAVTGEPVLREDVAGTSAGAGDGA

SEQ ID NO: 8605 - protein, 397 aa, Salinispora arenicola
MAHLLFVNVASHGLVLPTLAVVTELVRRGHRVSYVTAGGFAVPVAAAGATVVPYASEIIDADAAEVFGANDLGVRPHLMYLRENMSVLRATAAALDDDVPDLVLYDDFPFIAGQLLAARWDRPAGRLSAAFASNEHYSFSQDMIGLAGTIDPLDLPAFRDNLAALLAEHGLTRSVVACWQHVEQFNLVFVPKAFQIAGECFDERFEFVGPCFGQRRYLGRWTPPTDDRPVVLVSLGTTFNDRPGFFRDCARAFADQPWHVVMTLGDQVDPAQLGELPPNVEAHPWVPHVEVLERARVCVTHGGMGTLMEALHWGRPLVVVPQSFDVQPMARRIDQLGLGVLLPGAKADGQELLAAVERVAGDPALAQRVAAMREQVRRAGGAYRAAGAIEAYLSRRR

SEQ ID NO: 8606 - protein, 394 aa, Negativibacillus massiliensis
MYKIAFFCIPAHGHTNPTLAVVRELTRRGCEVRYYSYLAFREKIEESGAVFISCDEYGKTTVNSDNQAQVAFDLACSIHILTDTALALDEMICRTLKEFQPDCIVADSMAVWGKFAAYKLGIPFVSSTTTFAFNRFSARIMKPSLHQMLSTLKSLPGVHRDLKRLKKQGYPVKNFLSILQNEEGTPTIVYTSKEFQPCSDTFSDKYAFVGPSVCLPSPISKTPGKKLVYISMGTVNNRLPHFYQNCLAAFSDEKYAVILSVGNEVDISSLGTIPPNCTVEHQVNQLAILQQADVFLSHCGMNSVSESLYCGVPLVLFPQTQEQSGVANRVLELGAGLLLKEGQPESIRKAVEAVLSDPHLYQKAAEISESFHRAGGAYAAAEHILQQIKQKTIS

SEQ ID NO: 8607 - protein, 390 aa, Lysinibacillus xyleni
MSKIVFFSIPAHGHTNPTIPVVSELVKRGHEVWYYSFNEFQTKIERSGATFISCDDFLPSITEKEIARKAGKDFASLIEMVIDTTIALEDKVCKELKELQPDCIVSDSLCLWGKLFAKKLSIPFVCSTTSFAFNQHTAKLMKRGIKEIINMLIGMPRIHKKIQLLKSHGYQVENFVSIIENDKDTNTIVYTTKEFQPMAQTFSEKFTFVGPSIENANKIITNKSKKVIYISLGTVINQNYHFYRHCIEAFTKSNYEVIMSVGDHTNIASLGRLPDHFTVKNSVNQIEVLQKADVFITHCGMNSVSESLYFGVPMIVYPFHSEQKLVAKQVEDYGAGVRLTALKASNLVNVVEMVFTNDKYKKNAVKLSESFRSAGGAKKAADVILQVAQQ

SEQ ID NO: 8608 - protein, 547 aa, Anopheles darlingi
MDCGRRRKTGTNRNPMMLRLAALIVGGLLVAMVPVGTVQGENILFLQTICSKSHHIWNRQIFDRLYENGHNLTILSFEQEASVPGKTFLVMDEFQQKLMAKFADTATATDFSSYEGAFGNIMNVYEYYEVSSALLVEEPAIKRLLDYPRSFRFDLIVHDFTMGQFLLGFVQRFGNPPLVAVSAYNIPSYTQFLADIPIYTTYLPHPASSFGSRMSFTERARNTVYWWFDMLYRQQIFMPRENQRMQLLFEGDSLTHVKLLERRTELVLVNSDPALDFYQLLPPNVVQVGGLHIKRPEEMTPMMKQFMARANRGVVLFSFGTNVQSEMLGPEINRQLLELFRSMPEYGFIWKHANADGLIMPPNVLMTPWVPQSAVLANSRTKLLVSHGGLLSLQEAAWNGVPVIGVPFFADQFSNVRRLELSGTGVGIPSSKLNGETLREALEKLLNDPSYRKRAKELSNLFRAQPEPPLDRAIFWIEKVIANKGLRYLRSPARSMAPYQVYGLDMLAVLLLIALGYYLIFKRHSKPASTSTTAGSQQGPAMKRKEE

SEQ ID NO: 8609 - protein, 422 aa, Microcystis aeruginosa
MTHFGILCPTASGHINPLLPLGKELQKRGHKVTCFLTLDGEEMVQAAGLDFQAIAPDKYPKGTSAKNLAEIGQLRGTAAVRRTVQSVTNSTAALFETIPQEMRRLGIDALIVDQVSPSGGTIAEKLAIPFVSFAGALVLNRDPLIPPFMTTWDYNPSFIGVIRNKIGYKLLDSLTRPLNELINRQRQEWGLIPYQNINQRYSPIAQISQQPAEFEFPRPNLPAHFHFTGPFHDSSTRKTIPFPYEKLTGQPLIYASLGTIQNRLQSAFNAIAEACADLPVQLVLSLGNTDSNIQITTKNALVVPYAPQLELLTRASLTITHAGLNTTLESLAQAVPMVAIPITNDQPGVSARIKWSGTGEVIPISRLEVPRLRKAIEKVLSVPSYRENALRMQKALQKTGGVKMAADIVEKAISTGQPVLSV

SEQ ID NO: 8610 - protein, 392 aa, Bacillus mojavensis
MKKHHISIINIPAYGHVNPTLALVEKLCEKGHRVTYATTEEFAASVQQAGAEALIYHTSLNIDPKQIREMIEKNETPISILKESLSILPQLEDLYQNDHPDLIIYDFIALAGKLFADKLHIPVIKLCSSYAQNESFQLGSEDMLLKMKEAEAEFKAYLEQEQLPAVSFEQLAVPEALNIVFMPKSFQIQHETFDDRFCFVGPSLGKRTEQESLEIEKGDGPLMLISLGTAFNAWPEFYKMCIEAFRNSSWQVIMSVGKTIDPESLDEIPANFTIRQSVPQLEVLAKADLFISHGGMNSTMEAMNAGVPLVVIPQMYEQELTAKRVDELGLGVYLPKEEVTVSRLQEAVQAVSGDQEVLSRVKNMQKDVKEAGGAERAAAEIEVFIKKSAVPQ

SEQ ID NO: 8611 - protein, 407 aa, Ktedonobacter racemifer
MKYILANVPGFGHVNPTLPVVEELVARGEEIIYYVPEGFKDAVEAVGATFRPYELDLSNMAPPAMGQGGQMPGFQIQNALPFRMIKESQRILPQVLEQLRQERPDAILYDPMCLWARIAAQVLHIPAIQLRPSYAVNEHVKLFPMEPGNGARGPVPPPFMQQIREDIATLCEQYEFPPFDLQGIFGHAEPLNIVFLPRAFQPAGETFDERFVFVGPSIRPRHEKSAFPLEALEGAPVLYISMGTVFNNQLEFFKGCIEAFGGTEQKVVLSYGKRIQPVELGPLPTNFIASAYTPQLEVLAHTDVFVTHGGMNSTMESLYYGVPMVVFPQMVEQQMTARRVSEMGLGVMLESSSDSAQKLREAVERVRQDVSFHVRAQEMQRAIQQTGGYREAADAIMGHTQKTLQRA

SEQ ID NO: 8612 - protein, 422 aa, Calothrix desertica
MTHFGLICPASTGHLNTMLPLGKELQQRGHRVTLIGKLDVESQTLATGLEFKAIEESESPLGSGAEALAKLGKLTGREALQYTVHLLANNAAGLLREAPKVIKAAGVEALLVDQVSREGGTVADFLGIPFITICSAVVLNRDESVPPHFTNWNYNPTWWGRLRNRVGYQALNRIVKPITKAIDEYRQEWKLPRYSNPNDSYSQLAQISQQPALLEFPREKLPQWFHFTGPYHSVIGREVPGFPYEKLTGQPLIYASMGTILNPLTLFQQIAEAYVGLDAQLIISLGGSAKPESLAKLAGSPLVVEYAPQLELLQKAAVGITHGGLNSTLECLSNGVPMVVIPSVNDQPGVAARVAWAGCGEALPIKSVTVSKLRTAIQKVLMENSYKQNALKLQSCIRHAGGVSRAVDIIEQAVATGKPVIS

SEQ ID NO: 8613 - protein, 1071 aa, Vanessa tameamea
MIVNFLTFKLIVIIALSSFNEVQTLNILGVFPLPAKSHFFVFAPYLKELANRGHNVTVISFYPQKDPIPNYHDINLSDNSQPPQISHPVTKSLFIIFLSLTLLQALGGPFTCRMLLEDENVQNLWATQTKFDLVVVEQFNSDCGLALAHILGAPVIGITSHTLMPWHYSRFGVPYNPSYVTFDFFEGGPHPTFLQRILRTIIYNHVNFVFYHVTHRLEQNIIGEFFNDVPPLKELAKDIKLVLVYQNFMLSGSTIMPSNIIEVGGYHVAKVKPLPDELRKFIEDSEHGVIYISFGTLLKASTIRPDTLQEIINALEELPQRVIWKWNKQSLPGNPKNIYLAKWLPQNDILAHPKVLAFYSHCGLLGTTEAIYHGVPIVGMPIYGDQPTNAAAIEESGLGVQLHYVLLTKDYLLEKFKTVLDPKFRERVKFLSKAWHDRPVKAMDTAIFWTEFAARHKNFTFRTPAADVPFYQYFCLDILAILFIFFAVTIAILKYSITILIKIVFASKDLSSNGVRKVKINYFLVEHTRKVSSNHKPETHGRTRLSVILIMYSNTLRIAILLIIPFNVISLNILSILPYHGKSHFFVFKVYLQELSRRGHNVTVISHFPQTDPPRNYHDISLAGTIEAIEDNLPFHRSFLSILEVGLYLTNSGKVNCEIMLANKDVQKLVKDRPKFDVIVVEQFNSDCALGIAYKLQAPVVGIMSHILMPWHYNRFGIPSNPSFVPFHFLEGGTKPTLMQKVQRTVLDVYFKTMFYVFSQRSNEQTLAKYFDDVPPLENLAREIKFLLIYHNFILTGSRLFPANVIEVGGYHVKETKPLTGELLKFMEEAEHGVVYISFGSVVKSSTMPEDKVKAVLEAIAELPQRFIWKWENQNMLLDKNKLYTSNWLPQVDILGHPKTLAFLSHAGMGGTTEAIHFGVPMVAMPVIGDQPANAAAIEESGLGVQLQISDLTKDNLVAAFKKVLDPTFRKNAKLLSKAWHDRLMSPLDTAIYWTEYAARYPNMTFRSAAADVPSYHYYNLDVMGVFAIALLSTTYIFKGIVYTICSKNRKTTNNNEHSSKNKNKRRSKRE

SEQ ID NO: 8614 - protein, 415 aa, Daphnia pulex
MVAETTYGDSRIQTLLAKGKFDLVMFSEACGLTCYPFGWHFKAPTIAMSPNVLFPGRAALLGDEEHYSYVPFILSSYTDKMSLNQRLGNYLISKLFNTFVHDWHIDSVHSIFKKMVDPDCPPFIEIEKNFSLVFTNSHPSFSYPRTLPPQVIEVGGLHCRPARPLPDDLEAFVSSSEAGFVVFAIGSAIKMEDMPEEMIQSFIKAFARLPQRVVWQWKGKVRSDLPANVLAVPWLPQQDLLGHKHCRAFLTHGGLNSLQEAVYHGVPVLGFPFGTDQTLNVGRAVKEGYAAKLEWKEITQETLIKSIQEILHDSKYKKSAKRISGMFRDQIQPPLERAVFWTEFVLRHKGTDHLRLGSIDLAPYQRALVDVYFVFSLFFIIPLLLVFFCVRKCCCANKRPAAPPAVRNEQIKKRQ

SEQ ID NO: 8615 - protein, 519 aa, Orussus abietinus
MDCTKLILFVVLWCANLSASFRILGICPSSSFSHQQPFQALMKALVMKGHEVTVISTIPMKLPAKNYRNVDVSFTYRKKDCTGLRHVNAFKILMDNMNEANNLCEEQLTSDAVQQLMSRNETFDAVIIEQLWFQCYYALVKHYNYPILIGYLSVGNLPYVMDSVGNPDDPTLNPDMAYPFTDRMTLEERIWNIIYTTWCRLYYRYVHLPRVQRILDKWFPGTSVYDVDRNFSLVILGNNHVLGYPKPLLPNVVEVHSLQIQENPDPLPIEIQDFLDSGKDGVVYFSLGSNLQGHQLPPLTLKALFDAFSALKYRILWKYNNDASFNITNIKFVKWAPQQAILAHPNVKAYIMQGGLQSLQEAVHYMVPVIAIPFFGDQNFNARKILDTQIGLNLNVDSMTKETIMHAVSEVIDNPKYSKNIKQLGDILKDEPVKPLNRALWHVEHVLKFPNARHLRYHGRDISWLEHHTVEVLFCFAIILLISALYKCSVMRERNVIRHKCKMQNRFEEIASHSKSKDN

SEQ ID NO: 8616 - protein, 532 aa, Caenorhabditis remanei
MRLFYFSFLLIFQCSNAFKYLIISPIYSYSHVKFMSNIADKLADHGHEVVVFQQQILDSLRDKKDIKNPSIQVINYEADENGKEFYRNRPKSTVRKYWTTNQAATPWAADQFAETMSNDLEHMCLQVFQDKALHEKLKSEKFDVVIAEPFDPCGLYLADYLQIPSKIVAMASSRIDPVQWAVGQPSGLNFIPGPGSTYGKESGLWERVNNVWMFFMRTQMFRTVYWNLLDTIREKTGTAIRDIDEIVADSAYLFFNSNPYLDFPFPSLTKCVPIGGFSMNVSSWKTEKLPESLDKLLDEKEKTVYISFGSVIRSADMPEDYKNGVIEMMKSMPNVTFIWKYEDEDDIEIRKNIPSNVHLMAWLPQPALLADSRLSLFVTHGGLGSVMEVAYSGIPAIVIPLFFDQPMNGEMLKRHGGAEVYSKFDLKDSQKLSGVVQKMLNSDYPRNAKRLSNLLQKQPIDPTDRLIKHAEFAAEFKSLPELDPYSRQLNFAQYFFLDITVLVIVCILIMLRLLKLTIHFVRFLMRVKSKYE

SEQ ID NO: 8617 - protein, 526 aa, Caenorhabditis elegans
MLLRILTFLAVCQVTTSHKILMFSPTASKSHMISQGRIADELANAGHEVVNFEPDFLNLTDKFVPCKKCRRWPVTGLNNYKFKKIQNGLSGDVFQQSSIWSKIFNTDSDPYQDEYTNMCEEMVTNKELIEKLKKEKFDAYFGEQIHLCGMGLAHLIGIKHRFWIASCTMSVSMRDSLGIPTPSSLIPFMSTLDATPAPFWQRAKNFVLQMAHIRDEYRDVVLTNDMFKKNFGSDFPCVEFLAKTSDLIFVSTDELLEIQAPTLSNVVHIGGLGLSSEGGGLDEKFVKIMEKGKGVILFSLGTIANTTNLPPTIMENLMKITQKFKDYEFIIKVDKFDRRSFDLAEGLSNVLVVDWVPQTAVLAHPRLKAFITHAGYNSLMESAYAGVPVILIPFMFDQPRNGRSVERKGWGILRDRFQLIKDPDAIEGAIKEILVNPTYQEKANRLKKLMRSKPQSASERLVKMTNWVLENDGVEELQYEGKHMDFFTFYNLDIIITAASIPVLIFIVLRISNISIITSSPKNKKD

SEQ ID NO: 8618 - protein, 588 aa, Trichoplusia ni
MQGFVLVILYFAISGDGYNILGIFPHSARSHHIYFTALVEELSRRQHNVTVINYHPMPNLPKVVRISLLGKENASVTVNTEKRLELLSISDISMAYTTAIKYKDIANRNCIKMIENKKIRKIIDLAVHFDLVIIEQFVSDCGFAIAYKLNAPTIGISAHILKPWSYSRLGAPNNPAFVPNHFFASGAKPNLFNKMKSLIVNYGMNLYYERVIQKSDQEIVNKVYPDVPPLENLGKNMSLVLINQYFPLTRPQLYSSNVIEVGGLHINNKDGLRDKGLKTFLDSAQNGVVYISFGSLASNLPRRLINSIIQLLRKSNMAFVWKTDITHWDAPKNVFIGKWMPQVALLCHPKVIGFISHSGMLSTTEAVHCGVPIVSVPLFGDQFANGRSVVESGVGVAVDVLTITEKVLEGALETILEEKLERLCNFATHLVGAQPTSTVDNLLRMCEATSEHYGWCKTLTQDDTSNIRKKKIEDSVIRLCSKNFRYQRNAKQLSGVWKDRPMSPMDTAIFWIEYVARNKGAVNMKPVTVDMTFYEYFCIDIFLLIVIVLVLVVVSLLLTAKITFFAVRRIKLFLKDRKSKYFKVMSVS

SEQ ID NO: 8619 - protein, 524 aa, Branchiostoma floridae
MMFFTPFISVTVTSLFLLSCQFAIGKKVLLVPVPFADSHWLAQANLGRALVNRGHTVTALVSEDSLAERQSAEFLFETFEDRGTRARLKALEGRLVSNAAEMSLVGVVQAAIMLSQEMMKHCDFLLGDSNLLQRLRESRYGAVVTDPFFPCGAILAAHLQIPHVAHLRTNAYRIDLAATGVPQPPAYVPDFLLPFTDQMTFLQRTQNAVVSAMMSLLSHWILSSNFDGLARKFLGEDETLLSAMSRADLWLYQTDNVLDFPAPSMPNMIQVGGLNVREVVPLAADLETFVQSSGEDGVVVVSFGSIVKTMPTERAEVWAAALARLRQKVVWRYTGEKPAGLGSNTKLMGWLPQNDLLGHPKTRAFVTHAGYNGVSEALHHGVPMVCVPFFGDQPSNAARVVARGLGVKVEFSTVTADELYKAILHVLTNNSYQETAARLSRLHRDQPQSPMERAVWWIEHVIKHGGLPHLRARAVELPWYQYHLLDVAAFLLAVCAAVLGTVWYSCAFVCRMCCRKSYDKVKGQ

SEQ ID NO: 8620 - protein, 540 aa, Temnothorax curvispinosus
MLSRVIFLLICCILMGDIVIASKPLSILVVETVPSPSHHVWTEHLVKGLLRKGHHVHAVSILETKVKGKLAQNLTYAVFDSLMETYDESFNYDPVEWEKYSVFYGAYFMYQWGIHACNTMIKAKAARDLLEVTKTVEFDVIVQDITLSQCFYGLWEIAKGKPPIVGYVPFGAIPYLKDYIGGPSYPTVRSYTHAAIAKPEGLWLRTWNTLYYIVDDLIRHYYFFPIIQRLTEEYVGHAIRPLHKIERESINIVLINSHSALESAIPLPPNTLEIAGLNAQAVQPIAGEVIVMYSEDVRIFLDGAKDGAIVISLGTNVKWKHFNLDTVKTVILALSKLKQRVLWKLDIEVPFEISENIMVMKWMPQSEVLSHKNVRAIWTHGGLLSAQEAIWKGIPMIVMPFFGDQKSNTRILVAKGVGIYLDIKTLSTQSILHAVEEVLYNESYTRNMKQLSSEFRDRPIPPLDLAVWSVEYTVRHPNGTLVTPLRSQSWVEQNLIDVYALLFLSFFIILLSIFFVIKLLINFYYNYMYTASNLRKSKQA

SEQ ID NO: 8621 - protein, 494 aa, Toxocara canis
MMHKTIISIFLLHCMAHISIAYKVAIFVPDISGSQILFNVRVAETLVANGHNVTLIRLDSLATKKVEPKISPLIEQWRVKAYPDDNDYAAMRAHHSTIIFTATSFFSNDVTKALRLFVSSFITACEIIVQNKELMSQLKEAKFDIAFTHFYDYCPIGLIYHAKIPTWIWLNGAQLMDVIAYLVGVPSPPSYVPLLLSDMSDKMSFMQRVKNFLGRSLMHPLAMRSIIDPETEIFRRYLDPGMPHLSELASQCPLVMVNSDELYSLARPTLHKLVYIGGLGMNSRNVKPLEGEFKKIVDRSKHIVVMSFGSIANVTLMPASWKDSLIGAFRRFPEIEFIMRYPARDLDHKLPSNVHISNWIPQVDLLQNEKTLAFISHCGFNSIQETIYSGVPIIAVPLFGDQFVNGRLAERRRIGIVVPKNEFTQKRITNAIEEILNNPEYKNNVQRLLAMIRAKPVRPDEQLVKRLIRNCYQAHRETSTIAQDVNKQITIVNK

SEQ ID NO: 8622 - protein, 345 aa, Vigna angularis
MAVCPTDDRHVAVLAFPYGTHAAPLLNLVRRAAAEAPEVSFSFFSTKRSNASVFAGLNEEQLLNIRPYDIEDGLPEDFVPSGNPQDPVAYFVKAMPANYRTAMDEAVEKTGRQITCLVSDAFFWFCADMAEEMHAKWIPLWTAGPHPLLAHISSQQIREKLGPDGVGENKEIDFLTGFNGLKAGDLPEGLVEMPEDPFSMMLEKMGEALPRATAVAINSFSGVHVPIAQELETRFQMLLNVGPFILTTPQSVTLDDEGCLPWLNSQEDKSVVYISFGSVIMPPPDELTALADALEEGKYPFIWAFRGNPEKQLPDGFMERTKKQGKVVGWAPKCRSLSIQQLVCA

SEQ ID NO: 8623 - protein, 517 aa, Bicyclus anynana
MCCCNSIVVLLTLVLNCCYGYKVLAVFPMPGKSHSILGEGYVRHLLAAGHEVTYITPFPVKDPPSRLRQVDISENFAFMRNILDVRKFMSKELDIQNYFLVHNVMNSMLYDTYRMPVIQKFINDPKEQYDAVVVEWLYSELSAGFSSVFNCPFIWASSMIPHTAVLSLIDGHVNPAYSVDHLSRDYTTTFWDRLYHWYYITKLSYQRWSERDTYNDQFKNVFGEAITRRGHKLPQFDDVIYNGSLMLGNSHPATGDNVALPENYKHIGGYHIKDVIEPLPKDLQKLMDESKDGVIYFSMGSMLKSSEIPDDIKNGLLEVFGVLKQTVIWKLEQVIPNVPKNVHVVTWAPQQSILAHPNCVLFITHGGLLSIMETLNTGVPIIGMPFFADQYLNIARASAKGFGMRLDLDEKAPEKLRVAIKNMVENPSYRQSARKFSAIFKDNIASPGQQLAYWVEYVIRTQGAFHLRSPALQTSWYKKLSLDIFLVLLLGVILSFKLCKSLLVVIKNGSGHKKKTA

SEQ ID NO: 8624 - protein, 503 aa, Trichuris suis
MPCWNLTAKLLFLLFDITAISNGHKILFIPGHRVPSHTKSMLPLARALHNAGHVVGFLQIVGAAEEKVNIEPMQDFTLNVTAEKQARSFFQRIWIADMRSPKEYLEPWRRAALACNKALLEYEESKSSIVDMVKKWDLLVIDNLFAPCGMVASSLTGVDWIDFSTTVMMADMFRRNGLEMPLSVIPGFKVKHNDFDHRSFNHRVSNAVDGLQFSLLKAALFFLFPYWIEQSAREGRIVSFRSKPVYTFSSVPTYLTFLEPSTISFVPLDYPCLNPPKLDELYKTFIEDKSSKGTILIAAGHSVRWELAPRLFLQSFTDELKNLSDYRIVWQYAGNQTAVEMPHVLARKWIPQVSILQHPKTVAFLTHCGYKSLREAICADIPVIALPFFGDQFRNAAMVRKLSIGVHVDKADVQKSALRSRCYEVIRNRKYKANVAKLNALLNDKIIDDNWKANFLINFFFRHRKQNRCFALAATSLSYVQLYCLDMFLIFLASIVAASGILF

SEQ ID NO: 8625 - protein, 514 aa, Riptortus pedestris
MGSVVRGLCFLILLAESRVLGARILAIYPYKGASHFYVFQPLMEGLAKRGHDVTVVSHHPRKEPLPNYRDISVADQKELTTGYVEATPIPKNSLFYENVEGLHQLATEYERILANPDVLALANSSFDVIFLEMFNSDLFYGLAYRIGAPVIGFSSCSLMPWTADSMAVPNQPAYIPNNLGVHDLKMDWWDRVINTLEIWASRVYYRLVIETEAQKIAEKYLGPLPQLSEIAANTSLLFVNTHYSLLGQRPYPPSVIEVGGISVTPAKPLPKDLDTKLNESSGAIYFSLGSVMVASTISKEMKNMFQSVFTNIGKTVLWKFEEKLEPNNPNIVTRPWFPQRDLLAHPKIEVFISHCGLLGISEAVVSGVPILCLPVSSDQPHNALFVEEIGIGMHLDISTLTPSQLESSIFQILSNKRYRERASEVSAAFRDRPLPPLETGIFWTEYLIRHGRNVWETSYKTMPLWQREGLDVFFPLVGTILMVLWGLSRIFGLWRCRSNRQVKVKSKNHKKKQN

SEQ ID NO: 8626 - protein, 521 aa, Zygaena filipendulae
MKWCYTILFFLYFCHIAAAANILALFSSLSYSDHLVFRGYVSLLTQRGHSVVVMTSYPGQFQHPDVENIVELDVSEESAKFWDEYKNLITNVDDYYPLMKSLNELSLKVAIAQLKSKQMTALLINPNVKFDLVVTDANVPLLYAAADKYNASHIAITPSSGKIHQYEAKGSPTHPLFYPDENTLSYGNIGFWQKITELKRYYHTKQEYSSNYLRLSQLAAEKLLGLKRDLRSVEFEIDVLFVACNPLLVGKRPNALNVAYVDGMHIKTDLTLLTDLKTVLDSATKGVVYFSLGTIQESEQLSPILLQTLADAFGELPYTVLWKIGNTSMIKLSENVIAYPWFPQQEVLAHPNIKAFITHGGLRSLEEAVFYEVPIVGLPLVKSRKTFMGEITKHGAGEILDPYYLEKNMVKTTILAVAGEEKYQTAISLLKSKAEDTAISGPDHAVWWTEYVLRNGGARHLRSPSVGISSISYYMLDILSLLIFAAMTTVYTSYTILRFLIRWCRMRFFGQTGLSGKFKAL

SEQ ID NO: 8627 - protein, 514 aa, Papilio polytes
MKVTLVVCSVLVLITCGQIKQVNSLNILGLFPFPGKSHFFVFKQYLRELAERGHNVTVVSHFPRTDNPKNYHDISLANTSEILEDVFEVKKSYWALLRLSFALVEWGTDNCRVMLSNKNVQHAWNTTKFDIVVTEQFNSDCSLGLAHHLKLPVIGLASHALMPWHYSRFGISFNPSYVSHMFLSGGTKPSLYEKVERVLFDNYLRFIYKFYCQRIDQNTLAQYFDDVPPLEELGRNIKFQLVYSYFVHFGSSLYPQNVIEVGGYHVQKPKKLPDDIRKFIEESQHGVIYISFGSMLRSTTTPREKIETIIGALKELPQRFIWKWEEDSLPGNPPNIYLSKWLPQNEILCHPNVLAFYSHSGLLGTSEALYHGIPMLAMPIFGDQPGNAAAIEESGLGVQIEFMELTKEGLLEKFKQILEPGFRAKVKTLSQAWKDRPVSSMDTAIHWTEFAARYPNLTFRSAAADVPLYQYLCLDVFFILLVIPLFIIVLFLRYMFGNKKETKTTNNKKKSKRE

SEQ ID NO: 8628 - protein, 1178 aa, Blattella germanica
SNTIKYDLVFIEELLFPCYYGLVHHLGSPPVIAIAPALFFCSQVGDYASPENPSYVPSVLLPYTDSMSFLERLQNTLFFLFARTSLIFNYPVPLPPSIVTFRNEINQMMLDPLPKDLQRFLDDAPNGIIYLSFGSNVHSARMPKDKIYVFLDVFSELPQKVLWKWESDVLPAETSKVKFDKWFPQPEDHPDNGIEKAVWWTEYVLRHKGAKHLQSARKDLDWHQYLLLDVLASIIFAIIIMLYRSFWLLLLISYNESAKILGIFPMPAYSHQALYQNIMKALVARGHEVTVIGTNPLQVTIANYTDIDISFSYKFHKDEHNFEDMIHQKTIDFLHSQIILQPAIADLQLSSPQLQEFIRSNKIKYDLVIFEEILFASYYGLVHHVGSPPVIGITPFQYYWTQSIEFAASENPSYVPNLLFPYTDNMSFFERLQNTVTLLYLRYVLYSRVISENERVMRKHFGVAPPSITEAINNKSLFLIGSNWAFSYIHPLPPSAIRFQNAIIKKVLEPLPKDLQEFLDDAPNGAIYVSFGSNVHSARMPKKKIQAFLDAFAQLPQKVLWKWESDRPPSASINIRFQKWFPQQEILAHKNMKLFITHCGLQSLQEAVYNAVPIVAIPFFADQIFNAKKVEREKIGVQMSILHLTKDGLLNSINKIFNDSRNNAKRFSSLTRDELHSGIENVVWWTEYVLRHNGAKHLKTGATNLNSIQYFLLDILAFIVFSIALITICFFFFMFQHSFLLLLFLSCANAAKILGIFPIPSFSHQKLYQNIMKALVAKGHEVTVIGTDPLKEPIENYTEVDISFAYKLHKNENNFEDMVDQTPYEFLYSQVSVHPKLADNQLSSPQLQGFLRSNKIKYDLVLLEELFSPCYHGLVHHLGSPTVIAISPIQYFVTQPNYLALLENPSYVPSLLFPFSDSMSFLERLQNTFFLFYARYMVYTVLYPENEKVMRKHFGTAPPSIIEAMNNKSLFLVGTSWMFNYPLALPPSAVTFHNANIKTALDPLPKFRKWLPQQEILAHKNTKLFITHCGLHSLQEAVYYAVPMLVFPFFGDQPLNAKKVHTKKIGLQMSIHDISKDALLNAINKIYNDSRHNAKMYSALAKDTLHGGVEKAVWWTEYVLRHKGARHLRSAALDMNWYQYLLLDVIIFLILSASIILFFFSFIIYKIFRYFSRNNNLI

SEQ ID NO: 8629 - protein, 401 aa, Papilio polytes
MLSNKNVQNAWNTTKFDIVVTEQFNSDCSLGLAHHLKLPVIGLASHALMPWHYSRFGISFNPSYVSHMFLSGGTKPSLYEKVERVLFDNYLRFIYKFYCQRIDQNTLAQYFDDVPPLEELGRNIKFQLVYSYFVHFGSSLYPQNVIEVGGYHVQKPKKLPDDIRKFIEESQHGVIYISFGSMLRSTTTPREKIETIISALKELPQRFIWKWEEDSLPGNPPNIYLSKWLPQNEILSHPNVLAFYSHSGLLGTSEALYHGIPMLAMPIFGDQPGNAAAIEESGLGVQIEFMELTKEGLLEKFKQILEPGFRAKVKTLSQAWKDRPVSSMDTAIHWTEFAARYPNLTFRSAAADVPLYQYLCLDVFFILLVIPLFIIVLFLRYIFGNKKETKTTNNKKKSKRE

SEQ ID NO: 8630 - protein, 435 aa, Necator americanus
MMSFLDQPVKSSKFVVEILKNKQFLEWLEAEKFDIAFAHMFDVCTVGLVHTAKIPSWIWLNSGSIMDYVAYAVGVPIIPSYVPPMMMDVAGEMNFIERTKSVIGHVLMKVLWKRLIADPETELFRSLIRSDFPDLVDLSSKCPLVMANTNDLYDMTRPLLAKVVNIGGVGMEVVDAKPLPKNIEEIVAKSEGTVLFSFGSVTAAHKMPMEWKKSFMKAFKSFPNYQFFVRYEKEDLDDFLPGNVHLFKWLPQSDILRHPKTKAFITHGGYNSVQEAILTGIPLIAIPLFGDQLKNSRLIEHHGIGVILQKAEISTQTVIGAIEEVTGNSRYSKNAKRLSRMVERKPVSSAHLLVKWAEFVAEFRTLENLEPAGNKLNFFQYHSLDVLFNKRVAETLADHGHNVTVVLMQAVDDRAEAEIKFKENVNGRFSRETDR

SEQ ID NO: 8631 - protein, 521 aa, Papilio polytes
MNDNSRTFFLTIILTILFKYIQCGRILAVFPTPCISHQQVFRPLTLELLKRGHEMIVVTTDPMFPKHRELKNLTEIDLHDISYEAKDIILNEATPNKRSPLAQVFKMTELFTNLVEIQFRSKEFQKILKNNHTQYDLIIVEAWVRPMLVLSHVFKAPLIQLSSFAGLVYNYEALGVPVHPLRFPTFIHKKINNLSLWDKLKEVHLFLWFKYIIESSERAENAMLRRIFGPGVTISELSNNIDLLLLNVYPMWAGNIPVPPNVVYIGGMYKGTEQDLSEDLKLFLNSSKNGVIYFSLGSNVKSSQLSAKTIRMFLEVFSRLPYDVVWKWDRKELESEIPRNIMISDWLPQSSLLRHPKVKLFITHGGLQSSEEAISAGVPLIGIPFYGDQFYNAERYEQFKIGVKIDFDKITEHHLYKTIMSIVKDKSYRQNMIRLRSLMNDQPQCALERAVWWTEHVLRQKGAKHLRSPTANITWAEYLEIDVFIVILVLILLCTTSSIWLLYCVMRYMIITMFNVKIKTD

SEQ ID NO: 8632 - protein, 495 aa, Toxocara canis
MGHSHMNFLGHLADTLVRAGHDVVVYTPEYDTRIKTNGTKLARVIRRSSKFTLPPDSNHLNDNAWIRDGDDISEVYYMISRISSIQQTICEDSLSDEKLLAQLRAEKFDVGISEVISSCGFGIFEKIGLKKYIAAFATNLLPISTEPFGIDNNPSYVPATFARTSDSMNYCERVENFVSTLITYVIGRVMKRKVVDKAFHKYIRPNFDVHKTIAKSTFIFVNADEFVEFPRPITHKIVYVGGIAVDPPKPLDGELRKAMDAAVGGAVLLSFGSIAQSSKMTPAMKKAFVEAFRSFPKIQFIWKYEIDDDIAEDIPNVMKRKWIPQNDLLGHPNMRAFVSHGGMNSLTESVRAGVPIVCIPLFGDQMRNAKMVEKRGVAVVLEKHNLTANAILWAFTTVLTDQSFLESSRRLAKMIAKKPFPVDERVVKYTEFAIEFGQVNNLDSAARKLNFSQYYLIDIIVPLLLILLFFIYIVAWIIIYVFRRFFNSISKSKLD

SEQ ID NO: 8633 - protein, 211 aa, Theobroma cacao
MEIFEAMNMRTKPLLKDMLVEMIPPVDCIIGDGILEFVLDVANELGIPIINCRTIGACFLWSNYSIPDMIEAGELPIKGSEDMDRPITAVPGMEKFLRCRDLPSFCQASNMSDSTLLRYGTVTRKSLTASGVILNTFEELEGPMLSQIRSKCPNVYTIGPLNEHFKTRMSLENGVSSQSSNYFWEVNRSCMSWLDRQPNQSVVYVSLVALL

SEQ ID NO: 8634 - protein, 343 aa, Oryctes borbonicus
AFIFSENVGTLLQEQSRLSSFTMMKILPEILNMTLHSHAMQELLKPDNKFDVIIQSYMFNEAFLALSHHFNARVIGFVPFSTLPHIVSLTGNSAPYSYVPLPFSGHTDDMSFLQRTVNMIAGQFVSLLYNCCAYPKQEKIMRERFPDFPPLAEIERERVDLIFSNNHFSNESPRPQTPNIIYIGGYHVQEPEPLTPEVQKILDNSPEGVVFLAFGTHVQVEKLPKEKIDAFLNTFSKIPYKVLLKYDGFLANKPENVETVAWIPQRGVLAHRNVKIFVSHGGKGSATESLYYGVPVLCVSFFGDQWKNCEDIAEYNYGIHLPFQDVTKETFENAFDELDSNPK

SEQ ID NO: 8635 - protein, 528 aa, Haemonchus contortus
MLTLILLCGFLAVNSYKILVFSPTISRSHMISNGRIADELAKAGHHVVLLEPDFLNISHTVQSSKVAHRMTVSGFSSILHDVIQGFSGTAFEKISVYSEHRGILEYSRAYNQLCDDFLSREDLIEKLRAEKFDAYFGEQINLCGHGLAYILGIKSHFWVSSCPISDYMAWLLGMPQPSSYIPSLIGMDITHRPSYWERAQNIWSTFLYVQFARRGTVEATEMFRKRYGENFPNLEAIAADSDMVFVNTDEFVDFPRPTLPHVVHIGGLGEGSSSKSLKLDKIFSEQMEKGSKGVVYFSLGTLVNTSSLPAFAMRAVVDAVKKTPDYHFILVTDSRDHFTRHLSRALPNVFLCSWAPQAALLSHSRLQAFITHGGYNSIMEASRFAVPLVTIPFYFDQVRNSRAAELNGWGIPVNRFSLRDNPDGLYKALHAILSHKRYKQAAVRISTLIRTKPFNASEKLIKYTEFVLMNGGVKELLAEGRLLPFLQYHNLDIFIPLGVAFIFACWIFFRLVCTIFFIAFPPIKQKLQ

SEQ ID NO: 8636 - protein, 527 aa, Daphnia pulex
MVLNKFILLLLFVIGLIEASRILVSCPYGTKSYQNMYVPLVKELASRGHHITVVTNYQSSELDQTDNVDQIVFDQLAIDMSQFPNPFDAMLSKLVLLKSMALGVENMFTRPGIIAETLYNDQRVRDLMANDHFDLVMVSITFNAASYPLAWHFKTPLVMMTPNAIFPGVITSLGEEEQPSHIPFFMSSFTNQMNLFQRTVNTFTTHLFGYFIHQFHHEKIHGIVRKTILPDCPPLLELERNISLVFTNTHPSINYARAMPPVIVEVGGIHCRPARPLPRDLENFLADSDDFGFILFAVGSMLPMEKMAEDLAQSFIQTFARLPQKVIWQWKGKIRTDLPANVLAIPWLPQQDLLGHKNCKLFITHGGLNSLQEAVYHGVPVLGLPFGTDQKLNMRRAIDDGYATKLAWTEINQESLTSAIIDLLYNKNSKNVSYSTAAKRQHDLIHDQLQTPLERAVYWTEFVIRHGTEQLKMGSRHLNSFQRNLIDVYLIIIISAIVPLLLTFVCWRICCCRRQGNSQVDTNKKMK

SEQ ID NO: 8637 - protein, 248 aa, Temnothorax curvispinosus
ILQDVRIFLDGAKNGAIIISLGTNVKWKHLNLDTVKSVIRALSKLKQRVLWKLDIEVPFEIPENVMVMKWMPQSEVLSHKNVRAIWTHGGLLSAQEAIWKGVPMIVMPFFGDQKSNTRILVAKGVAIYLDITTLSTQSILHAVEEILYNESYTRNMKRLSSEFRDRPIPPLDLAVWSVEYTVRHPNGTLVTPLRSQSWVERNLIDVYAFLFLSFFIILLSIFFVIKLLINLYYNYVYTASNLRKSKQA

SEQ ID NO: 8638 - protein, 518 aa, Onthophagus taurus
MSPLIQSLFLLITLFSLTSSENILFVTTAPLYGAQMVLQPIWTQLSKSHTVTVITPNPTNQKNNTNLKEIDIKFIYEFIEMKYDFSQYVAKYKDEPLRYSTFLTTVLTGINNEVLKHPDVKALIKDDSLSFDLTIVEFITVPTMLAFGHRFKTPIIAITTTDASVLGQDSIGNPNHPALNPDLMLKFHGDLSFMQRVFSTLSLVSRKAVAHLVKRVEDETVSKHFGDNYPSLDELTDRIDLFLMNVNLGFHNLRPTVPAVVHFGGEMSVKPAGKLPEDIKKFLDDGKDGVVYFNLGTVIRARMIKPELLEAIFTSFARLPYRFIIKLDVPDTYPGKPDNIMIKTWLPQQDILRHENVKVFITQCGLQSIEEAIYHNVPIIGLPFFGDQYSNCLQAEEKGIGIIFDVNRLDSRKLIAAIEEVINTPTYEEKTKMISKIALDQPMTGLERATWWINHILRYKGGKHLRAPSLNVPFWKFYLLDVLAFIGFIVLSVFRVLYFLIKKCLRCCIKKSHKTKSQ

SEQ ID NO: 8639 - protein, 508 aa, Bombyx mori
MKLIYLLLLLVTCYTDGLNILGIYPYQGKSHFFVFRVYLRELAKRGHNVTIISHFPEQDPPANYHDISLAGTIKITEDNQSVRNSYWSVFSAAFYLAISGKENCQVMLANKQVQELIKSKQKFDVVVVEQFNSDCALGVAYKLGAPAIGMSSHTLMPYHYKRLGIPYNPSYVPFHFLEGGTKPSLFHRVERLFFDFFFRTFYYFVSQRSDQNTLAEYFDDIPPLEELARNMKFHLLYHNFILTGSRLFPSNVIEVGGYHVSNANPLTSDLKKFVDEAEHGIIFISFGSVIKSSTMTTDKVEAILEVMKRMPQRFIWKWEDKSLIVDKNKLYVSHWLPQVDILGHPKTLAFLSHAGMGGITEAIHFGVPVVAMPFLGDQPANAADVEESGLGIQLQFRDLTTESLLNAFQTVLNTTFREKVKKVSKAWHDRPMPPLETAIYWTEFVARNPDLNFRTAAADTPLYQYILLDVIAVLLTPLIIIFVALKRTRKSSAPIVKKTNGKKKSKKT

SEQ ID NO: 8640 - protein, 519 aa, Atta cephalotes
MRVVTVVLLSISLFCTFQYSHGYDILGICPSTSYSHQQSFQALMKALAFRGHKVTVLSTVPLKNAPPNYENVDLSFSYISKDCTGLRHIGAYALFHQNLLGANHICRHQLFSPAIDKLIASNKTFDAIIIEQLWYQCYYALVKHYNFPVLIGFLSVGNLPYVMDSIGNPDDPNFNPDMTYPFTNRMTINERIMNILYTTYTRLYYRYWHLPKAQHMANKRIPGTSVYDIDKNFSLVILGNNHVFGYPKPLLPHMIEVHSLHILENPGSLPKDIHEFLDNAQDGAIYFSLGSNLQTDQLPAESLTALCNALGSLKQRVLWKHNSNMAIHATNIKFVKWVPQQAVLAHPKVIAYMMQGGLQSLQEAVHYAVPVIAIPFFGDQYFNARKILDAGIGLTLNIDTITENSIVQTLTEIVKNKTYLNNIKTMSAIVQDELVKPIDRAAWHVEHVLKFPNSRHLRYHGHDMSWIHYYATYLCLGIGFVLLLYIYYILYNKIISPFVKMTCLSNLKQWINNLKRKLD

SEQ ID NO: 8641 - protein, 434 aa, Medicago truncatula
MDAPSPLHIAMFPWFAMGHLTPYLHFSNKLAIRGHKISFFIPKNTLNKLQHLNLHPNLITFFPITVPHVNGLPHNAETTSDVPFSLFPLIATAMDQTDKQIELLLKELKPQIVFFDFQYWLPNLTQKLGIKSLQYLIWNPISSAYLGNIPRKSQGKYLTKDDLKKPPAGFPDSSIKFHSHELRFLASTRKIEFGSGVLLYDRVDTGTKSSDAVSFKGCREIDGLYADYLETVFGKPVLLSGPLLPEPPKATLEEKWLTWLKEFKHGSVIFCAYGSEALKPPIGFESIEEALPEGFNERIKGKGIVYGSWIQQQLILEHPSVGCFITHCGAASITEGLVNTCQLVLLPRAGADHIMNARMMSSTLKVGIEVERGEEDGLFTKESVGNAVRIVMDDENEVGKEVRANHAKMRNFLLSSNLESSCVNSFCQKLYDLL

SEQ ID NO: 8642 - protein, 1065 aa, Papilio machaon
MLVSVLLSLIVISTFNKSNEVNSLNILGVFPYQGKSHFYVFEPYLKELSNRGHNLTVISYFPQKEPLKNYHDISLAGKSMIFEGIVPFQKHSSLTNMLTSLGLSYLAVDNCHIMMDDEEVQDLWKTKMKFDVAVVEQFNGDCALGLAYILNTPVIALTSHLLMPYHYDRYGISYNPSYIPFLLLEGSTESTLMQRLAHTISHIYMKFIYQYLTQRYEYKIISKYVNNMPPLEELGRNIKFLLLYNNMMLTGSNILPANVIEVGGYHVAKPQPLRDDLLKFIEESEHGVIYISFGSMLRTASIPKDKMQAILTALAELPQRVVWKWEAKSLPGKPKNIFVSKWLPQNDLLAHPNVTAFYSHCGMLGTTEALYHGVPLVGMPMFADQFRNAAAVEESGFGVTIKLENLTKDNLLKKFKTVLDPMFQANVKLLSKAWHDRPKSAMDTAIHWTEFAAKYPTLTFRSPAADVPLYQYLCLDIIFILSIIPITVICVVAIIYKTYFKSKSKQKSIKRSIFSVPIQGNYYIDYESDAVTELHETDLDCRDECISSITKMKITLVVCSVLVLLTCVEIKPVNSLNILGLFPFPGKSHFFVFEQYLKELARRGHNVTVVSYFPQKVKAKNYHDISLANSSQILEDVFEVKKSYWALLRLSFALVEWGTDNCRVMLSNKNVQHVWKTTKFDIVVTEQFNSDCSLGLAHHLKLPVIGLASHALMPWHYSRFGVSFNPSYVSHMFLSGGTKPKLYERIERVLFDSYLRLIYKFYCQRIDQNTLAQYFDDIPPLEELGRNIKFQLVYSYFVHFGSSLYPQNVIEVGGYHVQKPKKLPDDIRKFIEESQHGVIYISFGSMLRSATTPREKIETIISALRELPQRFIWKWEEDSLPGNPSNIYLSKWLPQNDILSHPNVLAFYSHCGLLGTSEALYHGVPMLAMPIFGDQPGNAAAVEESGLGVKIEFMELTKKELLEKFKQILNPEFRAKVKILSQAWKDRPISGIDAAIHWTEFAARYPNFTYRSAAADVPLYQYLGLDILLILFGIPLLIIVLFLRYIFNKKKTNSTSKNKHKSKKE

SEQ ID NO: 8643 - protein, 410 aa, Drosophila sechellia
MLSGPGIAGLLLTVLLFGLLCPKLANSENILAVFSYTFGSSYLLITPFLRNLVQRGHQITLISAVTIMPHIEGVHHIRVPKLDMLMKILLELEFDTEIPKWTEAQFLSEYFYNCSKFVLEDPGVQELLHNASAKYSLIILEASHNDALYGFSQHFNAPLVGIAAYGSSWNIDFQVGNSAPSVYEPISALGYTAGFSLMEKWHNLIFITEERLVERFIYLPRQIDLYKQHFPGATTSIHDLRRRFSLILINQHFTMGRVRSNVPNIVEVAGMHLDEKPYPLDAELKKILNEAKHGVIYFSMGLQLLETWLPPGMRATMSEAFAQLKQQVIWKSDHPEMVNQSRNVFARTWFPQRAILNHPNVKLFITHAGLLGLIESVHYAVPLLCIPLFYDQFQNTQANGEVGRGQASGL

SEQ ID NO: 8644 - protein, 242 aa, Ricinus communis
MAAQQHVAVLAFPFTSHPIALFNFVSSLATAAPKIQFSLFSSAKSNNSILSTAQNPRRIPANIRTYNVDDGCVSDGDIGLVKEINCFLNEFPGNSTASMDAVQMETGKRITCFITDAFFSSAVCKTAKDMNVPWILFWVPAPHVLPAYLEVDLIQQIYDNNAQAQQQPGGVILHDIIPGFSPISLLDLPSTIFQHEYRYRDSAKQMRSVLLSKTMSEASTVVMNSYQEINPAILTDYLKSKF

SEQ ID NO: 8645 - protein, 528 aa, Daphnia pulex
MKLVFVLVVFVTWLAVSEGSWILIVAAHGTKSHQNVYVPLTKELVGRGHHVTLITNYDIGEVAQHDNVNQILLEQLALDTSIFPNMFKALTGTWRDKIEMGVQVARMMFTFPAMVAETTYGDSRIQTLLAKGKFDLVMFSEACGLTCYPFGWHFKAPTIAMSPNVLFPGRAALLGDEEHYSYVPFILSSYTDKMSLNQRLGNYLISKLFNTFVHDWHIDSVHSIFKKMVDPDCPPFIEIEKNFSLVFTNSHPSFSYPRTLPPQVIEVGGLHCRPARPLPDDLEAFVSSSEAGFVVFAIGSAIKMEDMPEEMIQSFIKAFARLPQRVVWQWKGKVRSDLPANVLAVPWLPQQDLLGHKHCRAFLTHGGLNSLQEAVYHGVPVLGFPFGTDQTLNVGRAVKEGYAAKLEWKEITQETLIKSIQEILHDSKYKKSAKRISGMFRDQIQPPLERAVFWTEFVLRHKGTDHLRLGSIDLAPYQRALVDVYFVFSLFFIIPLLLVFFCVRKCCCANKRPAAPPAVRNEQIKKRQ

SEQ ID NO: 8646 - protein, 437 aa, Wuchereria bancrofti
MYHVEWYLASLIIIFHASQNDSYKILVYNPRFGKSHTKFLGSIADTLVNAGHNVTEFAPVLFEFSDSTGSKLAKTIKIDADPEISKIMNVEIFAQDAWKQNQQSIFSLISVLIMKRMSDALVKNCEFQLKQEKIMQELKSEKFDLAIFEFNQCFAGMIELLHIPAHVVVSPTALFEYATECFGVPNIPSYIPSLLTQYTDKMTYLQRLKNLIITILTTKLLDNHTIRCQALFRRLYGDQFIDLKEKLAQVTYVLTNTDPLFHISRPTIHKILELGGLALPKPQPLSKKWIAVMNKRKTVVLVSFGTVTLSCWMPNKTKKALLDAFDSFPNVTFIWKYEKDEHRIAEGHPNVITSKWLPQSDLLAHKNLIAFLTHGGMNSITETLNRGKPIVVVPLFGDQMQNAVLVQRLGLGIKLSLSELAIEGKYKMQSIISSMIK

SEQ ID NO: 8647 - protein, 521 aa, Trichogramma pretiosum
MLSYTSKRLCLAGLMLLLMLSLDRRPGAEAFNILGICPSTSYSHQQPFQALMKALAQRGHKVTVISPIPLKKPMENYTDIDLSFTYQKEDCTKLRHMSAYEILRKSMKQSNKLCEKQLFSDPIAELIARNETFDAIVIEQLWFQCYYSLVQHYNYPVLIGFLSVGNLPYAMDSVGNPDDPFLNPDMAYAFAGRMDFKERVWNYLYTTYTRIYYNYFHLPEAQSIAARFSPGVSCFSIDRNFSLVILGNNHVFGYPKPLLPNVIEVHSLQITGNPGKLPKDIQEFLNNATDGAVYFSLGSNLQSRQLPPLALKALSDAFGSLKQRVLWKHDGHVSAQADNIKLVEWAPQQAILAHPNVKAYIMQGGLQSMQEAVHYGVPLLALPFFGDQNFNGRKIVDAEIGLILHVDTMTSHSIKVAVEKLIYDPKYSRNIQKMGNILKDEIINPLHKAVWNIEHILKFSPSNHLRYHGHDISNIEYLATYCFIFSIVLFGISLLVWILVYIFRSLLHIGNDVIIKKKKHD

SEQ ID NO: 8648 - protein, 518 aa, Myzus persicae
MNNYNFIVWIFKFLTLFTASQSANILVFAPMPFKSHFRGFQPLFKELASRGHNLTVVSTFPLKTPQPNYTDIPISIDENILKGVDPMELASHGFLTVVPSLWKMSTFLAKKIIPKPEMQNFILSQDYEFDLVMVFSFCQEYSITLGHKYKVPVINLGVSTLWPSNSKWIGEPSTFSYILDQRTGATDQMSFIERFKNTVIGIYQLFLEDYYYLPLQKDTMEKYFKYKGHESRPPIEDMLRNVSVTLLNAHYSIGVTRPYLPGTIEIAGLHVNEPKPLIGKFLEFVDSAEHGVIYFSFGTIVDPSKLPNSTIEVFINVLKKLKQKVMWKWDSKNLPTQLPDHVMVSDWFPQPDILGHPNVRLFITHGGVHSLEEATYNALPIVGIPFFGDQHMNMRLAERNGIGKMVDHIDLNEKSMLSAIDEVLTNPKYKENSRIRSKIFKDSHLRPMDRAVYWIEYVLRHGGANHLTSSSVVLNYNQYFLADICLVIISTTAISMFLIAMLFKYTMKTKDYNSLKKK

SEQ ID NO: 8649 - protein, 513 aa, Heliothis virescens
MLLPIVFMLFAGASQGYKILALLPYPGKSHHMVFEPVLNELASRGHEVTVVSFFPSAKPIKNRRDVSLVGLAPLNVEVVNLQNFDDPSFFARKFSTPYNLVANVMDLNLQLCEKVLYSDVFKEFVDAEGAYDVVLTEHFQTDCMMGIVHNYGAPSVGLMSCALMPWTPARVGADGNPAIFPSMLLPFTDEMTFLEKLENSLNVHFYILWHTYITRNEQSVVEARLGRKLPPLEEIAKNASAVLVNTHPSLNGVRALPPSMVEVGGIHLHNKTVQPLPEDIEQWVSESKHGVILFSFGSLIRGSTLPPKHLDAILKVFARLPQRVIWKWETEDIVGLSENVLVRKWLPQYDLLHHPNCVAFITQGGLLSLTEAVAAGVPLVVVPVLGDQPGNAAYAKRAGIAEMLAIHDLDEESLYEAIVKVLSPEMRARAKAFSSLWRERPASPMDTAVHYIERAARYGHLNMSSHSRLLTKPELLFFYSIEYVVLLGIVFPIFIFVKCCCCSRKTMDKLKHD

SEQ ID NO: 8650 - protein, 436 aa, Myzus persicae
MRTGMRLVSGTAAAVMIFALAGWPGPVPSGCARILAVETVGGRSHWNFMSGIIRALVDNGHTVTAFTPFLDGDRENYTEVDISNGFPVGLDLDLVGLLDHFRNPLWTYGSFVEMGRSQCDVVYGSDEMKKLLQDRPQSSPAAFDAVLIESFWSECMSYVAARLGVPLIYVTPLPLIAFMERTITGHVSNPAAVSNLMTAHAVPETFLERLRNAALLVYGSVAQRYMELVLKYTEPPKEYDLLDPVPPSLVFVNRHFITDAPSPVPRNVVDVGGIHLKAAKSLPKDVLEFIEQSPHGVIYFSFGSTVKMSTIPESVKKALIKALARVPQRVLLKYEDEMEDKPKNMMTKKWLPQRDILLHPNVKLFISHGGISGLYETVDAGVPVLGFPLVGDQARNIDNLVNADMAISMDLLSVTENSFLNNVLELLNNEKYSMSA

SEQ ID NO: 8651 - protein, 375 aa, Trichoplax adhaerens
YDLVISDRMFMCNTLFAQAIGKQNVLYSTGGFGLRRGVLGNPYPLSYVPQMSTTFTPEMNLLQRCINVLVYLIGEIVYRVMFDPMTENLMRKFNISTHLSGADLDNTPSLVLLPVDFALEYPRPVLPNVKIVGPLTPRPASPLPSDLEKFVNESPQVVLVSFGTILDGLSDEKIAILLEAFNKLPYKILWKSKNVDLKTGKNVKIVKWFPQNDLLGHNNVVAFVTHCGHNSMYEAAYHGVPVIGMPVFGDQPDNLQQLLRRGVAVGLNTGNLTVDGVINAIKTVVTDDRYSRKMKELSVVIKSRPRTPLQTAADWIDYVLISNGAKHLRVEKYNLNFIQYYLIDVCFVILSIIYIIFKIFQFICRKCCRRQSKSK

SEQ ID NO: 8652 - protein, 419 aa, Daphnia pulex
MFTRPGIIAETLYNDQRVRDLMANDHFDLVMVSITFNAASYPLAWHFKTPLVMMTPNAIFPGVITSLGEEEQPSHIPFFMSSFTNQMNLFQRTVNTFTTHLFGYFIHQFHHEKIHGIVRKTILPDCPPLLELERNISLVFTNTHPSINYARAMPPVIVEVGGIHCRPARPLPRDLENFLADSDDFGFILFAVGSMLPMEKMAEDLAQSFIQTFARLPQKVIWQWKGKIRTDLPANVLAIPWLPQQDLLGHSGCRGFITHGGLNSLQEAIFHGVPVLGLPFGIDQYLNLARAVNDGYALQLEWRDVDESTLSAAIDKLLFNRSFSIAARRLSGLLRDQLQSPLERAVFWTEYVIRHNGSMDHLRLGSRKLAPYQRSLIDVYLVLVLIASLPLWLVFLCLRCCWSTKTKAATAMSKKSKQE

SEQ ID NO: 8653 - protein, 515 aa, Danaus plexippus
MSVVTTLIKISILLSLSNNIGKVQTLNILGVFPASIKSHFFVFEPFLKELVNRGHNLTVISYYPQKEPLKNYNDIDLSQNAQALELSHPITDSLFMTVMSMTVGHIVVAPLSCRIMLDDENVQNLWESETRFDLVIVEQFNSDCALALAHRLKAPVIGISSHMILPWHYDRYGIIYNPSFSLFDFMEGGTKPTFLQRLKRSFLYHYVNIVNRYITQRLEYSIVQEYFGNLPPLHELGSDIKLILVYQNFIFTGSSILPPNIIEVGGYHVKKPKELSGELLKFIEDSEHGVIYISFGTILKPSSIKPEKLKSIIEALEELPQRVVWKWNKRTLPGNPKNIYLSKWLPQNDILAHPKTVAFFSHCGLLGTTEAISHGVPIIGLPIFGDQPANAAAIEESGLGVKITLNLLNKDNLLKKLRTVLHSEFRENVKRVSAMWHDRPIRAMDSAIFWTEYAAKYQNISLRPPIVDVPLYQYLCLDIIFTFTCFLIFFILFIKFSVLFLMFPFSNQTYNKKLK

SEQ ID NO: 8654 - protein, 515 aa, Pieris rapae
MMYKIVTLFVLFCVCDGFKILIFFPIPGKSHSILGEGYVRYLSNSGHEVTYVTPIIMKNPPPRVRQVDISENIGLLPGHIFDIQKLMYKELDLQEMYIIRSVIRNFINGTLQASTMQNFMHDPKEEYDVVVVEWLYTELGSGLSAVFNCPLIWSTSTEVHSEILSLIGDGLNPAYSVYIWDREFSTTFYYRLRHLWLLFKDFYDRVIYKAIEDKMFEQSFKSAVESRGRTLPTFDEVRYNASIMLGNSHISTGDPHSLPQAYKNIGGYHIKEKIEPLPMNLQKLMDSSKHGVIYFSLGTMLRSSALPEGKTRELLDAFGTLKQTVIWKYEDQLTNVPKNVHVVQWAPQPSILAHSNTVLFITHGGLLSLYEILSIGLPLIGIPMFGDQFTNVNRAVKNGYAKRFDIGEQPIETLLHYIKEIIENPKYRERAKEMSRIYHSRTADPGVELVHWIEEVVTSQGASYLRSPALGIPLYQKYYLDFFAVIIVVFSTIGYLVRTLLSNLFKKSLDIKKIN

SEQ ID NO: 8655 - protein, 525 aa, Trichoplusia ni
MTKHIILSLYFIATIFATDCYKILGIFPSLDRNHYLTYRELIRELANRNHEVTLISHYQMPDAPASYKEILLSEDLQKVYKDLSFESVIVNEVSRVPIETLEATKTGNDDCKTLMNNHQVLHMLRTRPRYDVILVESYNSDCGLALAANLSAPYIAFNPHPLQPWHYSRLGINFNSAYVSQSGLSYGKGPWYFERLKSYVLYYITNCLYYVASQVTDHVYLYKYLGDDLPSLESIASHARLVFVNTHQSVYGGVARPDNVIDIGGIHVRPPKILPTEIERFINEAEHGVIYVNLGTATKDATLPGDKLNELLSTFGKLPLRVLWKWDGGNLQLPRNVMTMKWLPQYDILKHENVKAFISHAGILSTIEAIDAGVPVVAVPLFGDQYGNAAALQDSGIGTIVHYQDLKKEYLLDAINEVLDPIWQQRAKFVSRLWHDRPMSPSETAIYWTEYVARYQGAPNLQTASANVPFYQQLEIDVLAFIVLVLYILSYALYKILSALCCCCSRSEATESVEERRSSKRVKFE

SEQ ID NO: 8656 - protein, 509 aa, Caenorhabditis brenneri
MSTVSYILQEEGYNVTLLLPLIDVALKDTNLPITKKIKHQIKLDIHPGVLRAITAMGGKAARQQTWTFGSGIYGFYSIKHHLSDLYSYTCDGIFHNTELLERLKTERYEIGLSEPFFVCGFALFDHLGIKKILSIDSHIGLEGPKMAHGDPITSSFLPAAFSEGSDQMTFYERVLNLYETYLNRQFALLIHRKEMEGMKGIYKGLETWEELMRLPAYMFTNGNPLMDFPHPRTSKFIEVGGIAADEKRVDEVLPEFYNNILNLRNQTVLISFGSNARSTFMPIHMRNSLITALSEMSHITFIWKYEDTSVNIVKEFDESIENIFLVDWMPQQALLSDPRLSLFVTHGGLASTNEVAFSGKPAVMVPVFGDQTRNSRMLERHGGVLVLRKEQLQYPNAIKDAILTVLNDKEFARRACNLAELLNNQPQSPKDVFLKYFNFVARFGKPSGIDSSAPQLSFFTYYYIDLILVLLSIFITISIVLTSGAYVILFRIFNCKKGKEAITDKKKIN

SEQ ID NO: 8657 - protein, 254 aa, Caenorhabditis brenneri
EFTSRISEYPEGFVVLSTGFTAQWSKSPESIRQAYLQTFKAFPKILFIWQFDSAFEKSTVLPANLLIKPWLPLQDLLGHQKCLCHVSHGGLNSVIESVYHGVPVVGVPLTARGVDNLLRITARDSGVMIEKEEFGAEKLIGAIKEVIGNEKYKKEMLIFQDMVTDVPYTELYHAAFWVEFIERHQEVPHARSGADHLNFLQYFLVDVIAFFFFVIFCTISLIYYMIRTVIRTIRSVINGIRGVPRIVTKGKKNN

SEQ ID NO: 8658 - protein, 536 aa, Caenorhabditis briggsae
MLKCWLLLSIIGWVTAGDVLFIPSTLYPVHGQTMAVLAKELVDRGHQVTWLEIGTKQSDLVLPSEVTREFWPAQFGDSTLQDIYQYRNHSSHSQLWNPEHLNENEQTTGWLASIRLCDSVLTRSRSKFDRLVEKKFSTVIVDDLYNPCGVLIAGLKKSVYIYWSITGLRTESAWANQSPSPPSYLPVAGTGLTDDLTFSERVYNVASYLKQLYLHQHIVQPRVDAVFQKHYPGVSTMFDIERNASINFVNTPPIFDFSRPYMPRVNFVGAIQCRKAKELPKEFATKISEHPEGFVVLSTGFSAQWTKSPESTRQAYLKAFKSFPKLLFIWQFNGKLPEGSKAPSNLITKPWLQLQDLLGHEQCRCHVSHGGLNSVIESVYHGVPVVGVPLTARGYDNLLRITARDSGVMIEKSEFNGDTLTAAIREVTKNEKYKKEMLIFQDMVIDVPYTELYHAAFWVEFIERHQEVPHARSGADHLNFLQYFLVDVIAFFFFVIFCTLSVIFYAIHTVIRTIGSVINGIRGVPRVKVSKGKKTN

SEQ ID NO: 8659 - protein, 371 aa, Toxocara canis
MGHLADVLVEAGHDAVVLMPECDTRIKTSGTLRARTIRTSCNFDRLDDLLEPLDNMWSTNTRRMDFLFSRVENFVIFGITYVLTRFIAAPHALQPFEEHIRRPFTTVESIEILAKCPSIFINLNILLEYPREVNPKIVFVGGLTASRPSPLSEDFKRLMDESTGGVVLVSFGTVVFSSRMPPEVKSAFVSTFRHFPEITFIWKYEVDDEVAFDLPNVVKRKWVPQRDLLGHRNMRAFVSQCGANGMGEGIYGGVPVVCIPVFFDQMQNARKAEKQKMAVIIQKHNLTSQSLQSALMTVLYDKSYLDSARRISAMVRDSVIPVEEQISSRARITIKMKKVELLDPGSRRLNFLQFFLIDVISIPLILIFFLS

SEQ ID NO: 8660 - protein, 501 aa, Capitella teleta
MEVLRAVLCLLCVSMATTERILILNFPMKSHTSEMRMIGEELVRNGHEVYAVLPPSFPGIDDLKAKSTIRYLTYEMIVPDMYTAYDNVEVSPDWMEDLIRMTFLDDVSVYNVDPYFPIMAFCTNPLSDKKLYHQLEELRFDLALIDGFMEIRCLYILAYKLGIPYVSQSTQYEPWLQRNPALPSFVPWPIGTGDYGYTEKMTFWQRLYNTYSLVKFTAFPGVEYLSDDLVRKYAPEKPLVSIDQLAARSLLWLMDMDVLIDFARPMMPHMVEVGGLTTKPAKPLSADLEKFVAGAEHGVIVASFGSLGSNLPSRVNKRLMAAFSRVPQRVVWAFPHDAPEETPANVLVLRWIPQNDLLGHNNTKLFITHCGANGQFEALYNAVPMIAMPLFGDQPYNALRAEYNGIGLQMNILEFTPDDLTKAIDRVIHGDYGRQIQRLSDIFRSRPLTPVQRSAYWIEHILEYGGDHLKSYALEMPWYEYLMLDILLFVLGIALIAVTLL

SEQ ID NO: 8661 - protein, 268 aa, Priapulus caudatus
MPNVQHIGGHLCQPAKALPQKLEAMLETSYKKVVYVSFGTLMHGRKGVDENKRFMVALRGAVTNLPYFFMIAGFNMTSPPPNVVTLGWAPQNDLLAHSKVDAFFTHGGLNGLWQTICHGTPVVVMPLFADHFRNAHLAQERGIGEMIDFHTITTESLQSAFRRVVENDAYAARMRQLSKLYHHSLPMSPDETVSFWVNYTMLYADQQAPAYTELNFLQYWLIDVIACLLVIAAFFAWLTYVVLIASISISTRVIRRCCRRSIRNIITA

SEQ ID NO: 8662 - protein, 361 aa, Vigna angularis
MGNSEEKKHVAVFSFPFGSHPTPLLNLVLKLANAAPNLQFSFIGTEHSNKPLLISKPHIPDTIKFYSISDGVPEGHVPGGHPVERVNLFLQACPQNLQKGIDMAVAHTKERVTCVISDAFVAPSLTVAQRLNVPWVPVWPPLSCSLSAHFYTDLIRHTCNSAAGDTPLDFLPGLSKMRVEDLPEDVIQGVGEEETLFSKTLASLGSVLPQAEAVVVNFFEELDPPLLVNDMRSKFKYYLYVGFLTLSLPLPPLPPSDTDETGCLSWLDKQKGGSVAYVSFGTVVTPPPHEIVAVAEALEASGGVFTKDGLLKCLRLILVEEEGNLMKKNAVKVKRTVLDAAGAEGKAAQDFNTLVEVVSRS

SEQ ID NO: 8663 - protein, 533 aa, Plutella xylostella
MLAPLILLSAGVAALAGPAGAARVLGLFPHSGRSHQMVFEPLLRALAERGHHVTVVSFFPLDQPPANYTDVSLEGISPIGVETVNIEEFESLYSPYAWPRVLGVDRVLSQFLGFHPLAEMAVNICSKLVELPTLREALQKKYDVVLVENFSSDCMLGLLQAYGVQAPRVALLSSNLMPWSAERIGAAELPSYVPTVSTEFTDRMTFLQRMENAFVKLGLKQWFHYLIQEKEQELIEKSLGKKVDLQALAKNTSLMLVNTFHGLNGVRPAVPGLVEVGGMHLQRARKPIPPFMEKFLDESPEGVILFSWGSLIKTASIPPHREQVLVRVLSRLPQRVIWKYEGSAPEGNLTGNILRVNWIPQYELLLHKKVIAFIAHGGLLGMTEGISAGKPMLVVPFFGDQPCNGAAAEAVGLGTVLRYADLNEEAFGEAVRKVLSAPMRLSARQVSKIWRDRQTEPLETAVYWTERVARWGAASPLHSSARDLPFYELYLLDILAAALLAVVALLIVLRIMLKMLMYLLAALFVKQPKKKVH

SEQ ID NO: 8664 - protein, 527 aa, Caenorhabditis elegans
MRVLVFLLLFVLPAASCYKILVSVPKFGFSHMQTMGKLADILVEAGHDVTFLMPVDVPIPQNGTELAKVVLVPTTDAINEIMGHAMKSGAVANLWTHSANSKQGIMWSTDMIGQVSYHNTKNLIDNKALVQQMKDEKFDIGITELFDFSGLAFFEVIGLKNVMGAHTTSVFEGTLMATGAPILPSFVPASQTFTDDSGSILSRLNNLYMTYWSYQFQNKIQSFAQKALDEHYEKGKAPKIWNLVSDITWFFVNSDPIFDFPKPLPQNIVEIAGISVPEIKPVGKEWDEILSKRSKNVLVSFGSIASPTTMPEAVKKSIVDAFAAFPDVTFIWKYDDTESKLTAHLDNVHIVKWMPQNDLLADKRISMFWTHGGMGSLMESAQKSVPLVVVPIFGDQMRNAQIAKRHGVALIYDKMDLSNTKKLIGALKEVLENPEYKKSAELLARILATERFSPRQKIIDTVEMAGRFGQMPRWTSAGKEFSFLKYFNLDLVIIAVFIFFLSIVSTVLLIRHLLAKLGFSGDKEKSE

SEQ ID NO: 8665 - protein, 288 aa, Trichoplax adhaerens
MRKFNISTHLSGADLDYTPSLVLLPVDFALEYPRPVLPNVKIVGPLTPRPASPLPSDLEKFVNESPQVVLVSFGTILDSLSDEKIAILLEAFNKLPYKILWKSKNVDLKTGKNVKIVKWFPQNDLLGHNNVVAFVTHCGHNSMYEAAYHGVPVIGMPVFGDQPDNLQQLLRRGVAVGLNTGNLTVDGVINAIKTVVTDDRYSQKMKELSIAIKSRPRTPLQTAADWIDYVLISNGAKHLRVEKYNLNFIQYYLIDVCFVILSIIYIIFKIFQFTCRKCCRRQSKSKKD

SEQ ID NO: 8666 - protein, 489 aa, Lingula anatina
MEKIAILLRDHGHEITMLVADHYKPKHDLGDVKLIRFHIDDTEFNKGGVMDLQTAFDIIERDPVIVLKELDDLDYLLCHTLFSDNDILMQFRNSNFSLFLFDPLNIAAGTLLNEYLKVPSVGYWNQGFWNLWYVFHQPMFYSFMPNIPSGLSDHMNFWERLHNYEVDQSIRSWLEDKMDYIEGLRLKYLPKENIPHMKHAFERVSLMIAANAHFALDYPRPVMPHVKPISGLLWTPAKPLPKFFNDIVTDATHGVILLSFGTIVPHLEEEKAEMFARVFAKLSQKVIWRHDGKAPKSLGSNTYLVKWFPQNDLLAHQATKLFITHCGVSSMWEALYHAVPVVAIPLFWDQPQNARKLTDRVKVGVSLDYLTLTETKLENAIGKVLNEKSYRENAEKISIILQDTPMSGQEEFLFWLNYTMRHNGPLHFHSQAAYSLNWYQYFLLDVIAYKVAVSCLAISAYILLAVVLWKLMKTILKYFTSKNVKSKAA

SEQ ID NO: 8667 - protein, 502 aa, Toxocara canis
MSSALILSVIVILSSCCEGHKILVYSPKLFYSHFRFMGHIADILAAARHDVVVLMPECDERIKTNGTTLARPMRANCSFDGLSELLSTLDDIWIINTGRMDFLFSMAWALSSKENLICRGLLGDMELISRLRNEKFDLGISEAFSFCGFGVFDKIGLQKHLSAFNTQLIESMTEPYGINYNPSHVPALLSQSDDAMSFVERMQNFIVFGTTYVLTRFIAVPHALLSFEEYIRRPFTIAESIEILARCSSVFVNTNILLESPRELNSKIAFIGGITATQSSSLSEDFKHLMDVSSGGVVLVSFGTAALSSRMPTNLKYVFVSVFRRFPEITFIWKYELDDEVGSDLPNVIKRKWVPQAGLLFHKNMRAFVSQCGSNALSESVYAGVPIVCIPIFIDQMRNARKLEKQHSALVIHNRNFTAQSLEVALRGVLYDKSYSISARRVSAMVRDAIIPLEEQISGRARIAIKMKKVELLDAGYRKLNCLKFFYIDVICIPLILIILLS

SEQ ID NO: 8668 - protein, 515 aa, Plutella xylostella
MILRFCFIVISLALCLSVPSESARILAVFPTPSISHQVAFRPLTQELAKRGHQVTVLTTDPAFKKGQQPANLTEVDLHDVSYTAWAEHFMKVVNGDSGNSKNIMLTIFKSLNLVFELQLHMKEVQEVLNSKQQFDLILIEACVRQALVFSHVFKAPVIQVSSLGAVPPNYQVLGAPSHPILYPELTRQRLFDLSIVEKIQEIYHDMWIRYLLWSLEDSENKMLKKVFGPNTPSVSQLYENVDMLFLNINPVWDNNRAVPPGVIFMGGIHQKPHKDIPPSDLKTYLDGSKQGVIYMSFGTNVNPSQLPADRIALFNKVFSKLPYDVVWKWDKDSMPGKADNVKIVKWVPQSDLLRHPKVKLFITQAGLQSTDEAISAGMPLIAFPMLGDQWYNAEQYVKHKIGLKLDIAEITGELLEQSIKQVIHDKSYRDNIRALHTAMTDQPQSPLDRAVWWAEYVIRHKGAKHLRSAAANIPWSEYLMLDVVAVLLSAVVGVLAVVYWVVRCLFKQTGKVKKA

SEQ ID NO: 8669 - protein, 544 aa, Caenorhabditis remanei
MRAPLLLLLLFATSSLCFKILVSVPKFGYSHMKTMGKLADILVESGHDVTFLMPVDVPIPQNGTELTKVVLVPPTDEVSQIMETSMKSGAVANLWTHSANSKQGIMWSTDMIGAVSYHNTKSMINNKALVQQMKDEKFDIGITELFDFSGLAFFEVIGLKNVIGAHTTSVFEGTLMATGSPILPSFVPGSQTFTDDSGSILSRLNNLYMTYWSYEFQNKIQGFAQKALDEHYGKAKSPKIWVGVFVLILAYLSSNLFQNLVKDITWFFVNSDPIFDFPKPLPPNIIEIAGISVSKIHPLDKEWDEILNKRSKNVLVCFGSIASPTTMPESVKKSIVDTFAAFPDVTFIWKYEDTESGLTAHLNNVHIVKWMPQNDLLADKRVSLFWTHGGMASLMESAQKGVPLIVVPIFGDQMRNAQIAKRHGGAVIYDKMELGNSKKLIGVLKEVLENPEYKKSADLLAQILATDRVSPKQKIIDTIELAGRFGQMPRWTSAGKEFSMLKYFNLDLVLLFIFIVFSVVLSVVLLIRRVLVKLGFSGKKEKSE

SEQ ID NO: 8670 - protein, 272 aa, Citrus unshiu
MSEAAGSTQRRHVAILAFPFGTHAAPLLDLVRRLSEAALEEEVTFSFFSTAQSNGSLFMEKDELRDCKIVPYNVESGLPEGFRFTGNPREPVEHFLKATPRNFVRALEKAVAKTGLEISCLITDAFLWFAGEMAEEMRVPWIAYWTAGPRSLLAHLDSDIIREIIGVNGPENQTLESIPGFSSIRAKDLPEGIISGPLDSPFPIMLDKMGKTLPKATVVAINSYEELDPIVVETTPKSKIPKISPTLANFHLNISPPKFLILMAACHWLNGT

SEQ ID NO: 8671 - protein, 315 aa, Medicago truncatula
MEIQWFIRSLSSQLGQNWKRRGCHEVLLSLLHFSSVPNFARSSLSSLSCFSGRNFSRFTRTKHTLRDNSHHKISSTEGVNNNDKQLHVIMFPFLVFGHISPFVQLSNKLFSHGVRVTFLSASSNIPRIKTTFLSDDQINELALGLELTGLPFTLGLNFPSNLCAKTELERALPKGFLERVKDRGMVHTGWLQQQLILKHNSVGCYVCHGGFSSVIEAMVNDCQLVLLPFKGDQFFNSKLIANDLEAGIEVNRKDQDGYFHKEDILKAVKTIMVNDEKEPGKSIRENHMKWRKFMLDKENQNKFIIDLVSQLKSLA

SEQ ID NO: 8672 - protein, 526 aa, Drosophila erecta
MLSGPGIAGVLLTILLLGLLCPKLTNAENILAVFSYTFGSSYLLITPYLRNLIQRGHQVTLISAVTIMPHIEGVHHIRVPRLDMLMEALLEYEYDAHLTKWTEAQFVSEYFYNCSKFVLEDPGVQQLLHNASAQYSMIILEAAHNDALFGFSQHFDAPLVGIAAYGSSWNIDFLVGNSAPSVYEPMSALGYSPGHSLMEKWHNLIFITEERLVERFIYLPRQIDLYRQHFPGVTASIHDLRRRFSLILINQHFSMGRVRSNVPNIVEVAGMHLEETSHPLDAELQKILDEAEHGVIYFSMGLQVVDNWLPPGLRATMSDVFAQLKLQVIWKSDHPAMVNQSRNVFSRTWLPQREILNHPNVKLFITHAGLLSLIEAVHYAVPLLCIPLFYDQFQNTKRMEKLGVARTLDHKNLSRDEIVLIIEDLVHNASYKENARDLSKRFHDQPMSAMNTAIWWTEYILRHKGADHMRIAEQEMSFMQYYNVDVVSVLFGRIGLSVIIVIFLGWKLVLLARRNLEFRFNVPMVR

SEQ ID NO: 8673 - protein, 539 aa, Drosophila guanche
MDIKRNSPKWRRTTMAFLVVVVVVLLLPASSEAAEILGLFAHPGKSHFEFFRPIFRELAGRGHNISMYSYFPLEQPLANYTDYVFKGSPLLTDVIDLMKFKTTERTLLGLPYKIPTYFMLHSWGMRFCQSALNSPLIADLLSSPLRYDLIILEHFANDCMTAVAHLLNAPVVALSTCAIMPWHYQRMGTPHINAIMPMNFLTYSDEMGLIDRLNNFIHFHTVNTLYEWITQPATDALISQRFGFGLPSVNEIVKNTSLMLINQHYALTGISPYAPNVVEVGGLQIGPQKPLPEHLEKLMEDSLSGVIYISWGSMVDPTTLPIEKRRALFKSIAHMKDYTFLIRWKSDKPLAQDKPSNLFTFDWLPQRDLLCHPRVKAFISHAGLLGTTEAVHCGVPMLVTPFFGDQFLNAGALAQRGFGVIVHFGDFDEQHITSGLQKILEKEFADKVRRSAKAFRERPQSPLELATWWIEHVIDTRGAPMLENRARHINWFVYNSIDVYLCCLAIIGLPLFAIWQLVRLLRLTLGLMNATKNQKTKVQ

SEQ ID NO: 8674 - protein, 638 aa, Gregarina niphandrodes
MAGTGDFAMGAVLQVSGTCEIKFINSTVHISHGGPATDTVVAKPTGNKGTDESAVAATELAAKSAVVAESEIMAGANKEDSIASELEVAVLCFHGFGHIAPSLHLSERLCQLHKGCSVTLFGVVSSTQQLGAIKNLIAENPRVRVYAIVAQDDEDSFSIYAQDVKNGRWVARVKKFYDSGLMDLRAVIVDSTGCHSAGSPACESDGKPPGEEKNPVDKSSWAAVVITTPIRRPKVVVPDMFVGYDTEVARHFGIPSWQFHASSLAFVSVADPHAETTIPGVGVVEPIETSPAHVDKFKGLLDAENLARRYREGILVNDVADWWPHEAVEMARQRVTRAEDGRNWQVLCVGPLYKCREQAAQQLGRIQTTEPNHSVEPRQATQTNPAVANTPNQTLPRQSTPNGTTTLEQSTPDQTEQTELSGGAKTELSAQENKEVRNHFDSQRGCRCDSQTQTDEDLGDLTPEESPASADTAEAWLNKQRPRSVIFVSMGSQFDLRAADLLELASALEEMNVPVLWALRLPKQNNIMVTALKSEDAQKMSEDAQKMSEDAHKSGDIESWLPENYINRNCGKIKIISWVDQVAVLKHKAVRVFLSHSGWNGTLEAMSSFEGPIVCLPLGAEQAMNAKIQEEYFKNGLR

SEQ ID NO: 8675 - protein, 514 aa, Toxocara canis
MLSVLILIATVLLSSCCEGHKILVYSPKLLYGHVSFMGHVADVLVEAGHNVVTPFLKDFTLRLPSSPEATNFETALPGLKFLLSLVDRCERFSYASDEICPFFRLKKDIQSNGPYQNSKELQTRNWGALLGDVELIRRLREEKFDLGISEAFSFCGFGIFEKIGLQKYLSAFSSEFIETLTEPYGISYNPSHVPGEDLTLLSRSSDIMSFIERVENFVIFGITYVLTRFIAAPHALQPFEEHIRRPFTTVESIEILAKCPSIFINLNILLEYPREVNPKIVFVGGLTASRPSPLSEDFKRLMDESTGGVVLVSFGTVVLSSRMPPEVKSAFVSTFRHFPEITFVWKYEVDDEVASDLPNVVKRKWVPQGDLLGHKNMVAFVSHCGTNGLGESVNAAVPMVCIPVFFDQMHSAKKLEKQHTAFIIHKHNLTAQSLQWAFRTILYDKSYSVSARRISAMVRDAVIPIEEQISRRARIAIKMEEVEMVNPGSGRLNYLKFFFIDVISIPLILIIFLS

SEQ ID NO: 8676 - protein, 1011 aa, Haemonchus contortus
MYNILLLCYITTCTYCANILVWNPTIGYSHVRFLGSIADILHQDGHNVTIISPIVDPRVDMIGHKYAISQIPYESKYMDQAEDYSKMGIKTSSFWESPVEQGFSLSRSDFEGFVKNTQNMYRGLAEDKVFLARLRDCNFDIAVHEIYDPYQVGVFELIGVKKTVAVSAIGITPYVREVTGVSTNPSYIPGSYTTYGDEMSFWERLDNFKLEIELSYRSYIWERKVWSYFNAVYPGFPDFKELLKQKVGVVLLNVNEFIESPRPTANIVRYIAGISIPEPKPLDKELSALLDKRSSNVLFSFGTFTQAKNMPLWLKKDIVEAFASFPNTTFIWKYEDESETEVFGAHPNIHRMKWLPQKDLLADKRLSLFITHAGMNSIIEATFAGKPMVAIPLFGDQFLNAKNLRRRGLAIMIERNKLTRDTLVAAIREALSPESSYAHKAAVVAQQLHGRAAAAREELSRWVNLVAEEGQMDHLLLRMLLLVLLLTSVPFISCLNVLIWSPTVGQSHVRFLGNIADILADDGHNVTIVSPVLDLDVRAHTHNPAVLHLSYHSKYMRPNEDDDFSKLSIKGTSLWDAETLEGRSCTTQDMALFVELLKNIYRGILEDEEFLNRLRNSRFDVALHELYEPFSVGIFELIGVTKTVALSAFGVSLYVPEITGVPANPSFVPGAFSTYSDSMTFWERLNNFIYEFELDIRYRIWERQLWLHFNEVYPGFPTFRELLKKQVGVVLLNINEYTETPRPTANIVRYIGGIAIHPPKPLSQVDKRLDAILNERSTNVFLSFGTISQSKDLPLILKKDIISAFSAFPNTTFVWKYEDENDIHLFKNHTNIHTMKWIPQSDLLGDKRLSAFITHAGMNSVLEATFSGKPMVVVPLFGDQYLNAKNMERRGTAVMIDKRDLNKGTLTAAIREVLSPNATYAHKAATVARSLEGRVAAARADLLYWVKLVAEEGQMDHLMMRARDLSFIQYHCLDIIAYLLAQFVVTLIFVFFVVRLLVRRVSVVFKKRKTE

SEQ ID NO: 8677 - protein, 519 aa, Drosophila busckii
ISASCKMLLLYCLIIHLAQTSGLNVLGLFPHPAVSHFQFFQPIMRRLAELGHKVDVLSPFKDANPLPGYKDYALSSASFSNAMSFDLFEQRSLPFLLPFEEFFILHKYGKQACNTTLRSSALEQLLKQPAGHYDVILLEQFNTDCMMGVAHQLKAPVVALSSSALMPWHYERMGAPQIPSYISALFLGQQQPMDFGGRLTNWLTIHSLNWLYSLFSVPSADAFLRQRFGPGMPSTAKLVRNTSIMLVNQHYALSGARPLPPNVIEVGGLHLKQPRPLSAKLQQILDQAPHGVILISWGSQLRASSLSSRKLDGLLLALSRLPQQIILKWEEHTLPHCPSNVHVMKWLPQRDLLAHPNVRLFFTHGGLMGITEAVASGVPIVGMPIYGDQFLNVAQLMAHGSSVKLEFQQLSEQTVYAALSQALDPSYKLNAQRLAQAYNARLEQPLDSVVWWVQHVADTKGAPLLQPCAVKLNWIIYHSLDVYLAITGALLLLLLISSKLWRRCHAPKATASKPKSKRN

SEQ ID NO: 8678 - protein, 461 aa, Temnothorax curvispinosus
MLSRVIFLLICCILMGDIVIASKPLSILVVETVPSPSHHVWTEHLVKGLLRKGHHVHAVSILETKVKGKLAQNLTYAIAKGKPPIVGYVPFGAIPYLKDYIGGPSYPTVRSYTHAAIAKPEGLWLRTWNTLYYIVDDLIRHYYFFPIIQRLTEEYVGHAIRPLHKIERESINIVLINSHSALESAIPLPPNTLEIAGLNAQAVQPIAGEVIVMYSEDVRIFLDGAKDGAIVISLGTNVKWKHFNLDTVKTVILALSKLKQRVLWKLDIEVPFEISENIMVMKWMPQSEVLSHKNVRAIWTHGGLLSAQEAIWKGIPMIVMPFFGDQKSNTRILVAKGVGIYLDIKTLSTQSILHAVEEVLYNESYTRNMKQLSSEFRDRPIPPLDLAVWSVEYTVRHPNGTLVTPLRSQSWVEQNLIDVYALLFLSFFIILLSIFFVIKLLINFYYNYMYTASNLRKSKQA

SEQ ID NO: 8679 - protein, 525 aa, Bombyx mori
MRAHIACIVLIAHAVASAKILGLFPHTGKSHQMVFDPLLRRLAEKGHHVTVVSFFPVKNPPANYTNISLESLAKLGVETIDLSWYESSNSILKMTGPEKIYEELTAMQPLSYMAVDVCSKLVGFEPLARTLRQDYDVILVENFNSDCMLGLAHIYGQKAPIIALLSSSLMDWSPSRIGVSDNPSYVPIVTSTFTTPMSFVQRLKNTVLNIYYKLWFRYAIQLKEKEIIENHYGRKIVDLEELARNTTLMFVNVHHSFNGVRPLLPGIVEVGGMHLDHKRKPIPEFFERFLNDSEHGVVLFSFGSLIKTSTLPKYKEDIIMKTLSQLKQRVIWKYEDSAEEGTLVGNVLKVKWIPQYDLLQHSKIIAFVGHGGLLGMTESISAGKPMLVIPFFGDQHLNGAQAEKIGFGKVVSYADLSEKTFLDGLQSVLSPEMRLSARRASNIWSDRQADPLDTAVYWTERVIRWGHRAPLHSPARDLPLHQYLLLDVAAAILVAILVLIAILRLIVVLIIRFFSGSVTAKEKLH

SEQ ID NO: 8680 - protein, 532 aa, Lingula anatina
MYQVIDRLGLSLFLGLLCLTTSCHGDKILMLPYGATHTSRAMNMEKLALMLTEHGHNVTMIVRADYTPWRPLPGVVLETYNVTVNDGSQLPRKLDFKTMMRLVKSDIFTLIHIESESNRETCKHMLSDKQLMSKIKRGTFSLFIFDYLELCSAILLYQLKLPSVMYSNYGLTGLWIANQNPLNPATTLMEGADFTNNMNYIERFRNTMLWIAANAFYNYYYIRDIENLLSTFLPDYNFPPIHRCFENVSIIIAANTHFALDFPRPVMPHIKPISGLQWTPPRPLSSDLLSFMSSAHHGVILMSFGSMMPTLEEETAELFAKVFSKFPQKVLWRYKGPVPPSLGENTKIMEWIPQNDILAHPAMKLFITHCGISSTWETLFHAVPVVAVPLFADQHHNAAKLVKRAKIGVLIDFHTMTQIELEEAINEVLTNEKYKQKAAKMSEILQDVPISGKDEFLFWIDYVIRHRGPLFLHNEAVFKLSWYQYYLLDIILPFVAAFLCFTFLLKVFAVCMFKAAVRVIRLLLKRVKLKRS

SEQ ID NO: 8681 - protein, 510 aa, Acropora digitifera
MMTVLVVSLLLLAANSALSARIAGFHMAGGSQYLNTKLVLEELASRGHEVIMITPSSQKAKSSAKVPHAFYQVPYKQGFIEDTVLRLQLEGRHFQSFSQMPYLLLNICEGALNSTKVANELKGVDLMVHDSLSVCAVLLGERSDIPRVEIVVVPPSSPVGFIHMIPMPVSYVPQLLSGLTDKMTFFERVLNLGAYLSLLTVINLGIGRPFNQLKVKYNIKPERSFQTAITDAELCLITADFALEYPQPLLPDQIMIGPLNVKDPKPLPADIEAFVSESGPHGFVIVSFGSNVASILPREVVDVLANAFGELKQRVIWRLQGYIPSHLNSNIKVVDWLPQSDLLAHKNIRAFVSHVGHNSLYEAAYHGVPVVAVPLFGDQPANAKKVERRGFGVAVDYRNTDARKVFETIDKVVTEPSFKEKAMHISRLMKDRRRTPLEEAGDWIEYVFRHGGAQHLRAQVFNIPWYQYYLLDVIAFLVATVIFVVMVIQMTYGCLCRFCCKKSREKPKNE

SEQ ID NO: 8682 - protein, 224 aa, Citrus unshiu
MLDFGFRYLYGDISRAVGRFLQFHLRTATSVQEATQSSSEQHVAVLAFRFGSHGLTIFNLMLKLASAAPNLKFSFFSTKKSNDSFLSASKARLPDNIRVYDIEDGVPMKYASTESNPLEAVELFVKATPENFKKGLDAAVSKTGRKISCMLTDAFLTFSGEMARDMHIPWFPVFVAMPYNGSAHIHTDLIHQFFINSSGSLRLEDQTLDIIPGLSMMRISDLSD

SEQ ID NO: 8683 - protein, 541 aa, Drosophila mojavensis
MSWRVFCRMSWLWCWLLAGLTLCHAGSGSNILMITMGGTKSHKIPFWALGRALVKRGHRITFVNGFQADFHVDGLEEVTPQRLVQYIANYTDWDLVGARYSGHAPLSMADAMRYPIEACNSLLNDPATQRLLGNGTWPGHAQYQLAIVDGAYPECALGIVHRLNVTAFIYINTVAFYTGSVSLAGNPVAYAVTPHVFGTWTLPMDFLQRVANCLTHVIADLLHWLCMQRVHRLLRHHLGEDVPHPYVLGRDVSFILQNSHPSVRYPSAHLPNVAEVACLHCRRAAVNLSQLDVELSGFMEAAPDGVIYLSMGSSVRSARLPAKLCELFVAVFARLPQQHVLWTWAGNASEQLPQLPANVLVRPWLPQQDILGHRRLRLFITHGGLLSQHEAVFHGVPLLVLPVFCDHDANAAQAQRHGYARQLQLAHLDEEALYCAIYDVLHNDGYRRAVRQRRALIHDQLATPVRQAVYWTEYVMRHKGAKHLQHPGRHMSFCSYHSLDVLCLLVVMLLLVVQALRRLHKYLAGSIEAEKRNNGKNSLKI

SEQ ID NO: 8684 - protein, 539 aa, Drosophila pseudoobscura
MDRKRNSAMFRWRRTTMAFLGVLLLMPAIPSEAAEILGLFAHPGKSHFEFFRPIFMDLARRGHNISMYSYFPLDQPMANYTDYTFKGSPLLTDVIDLMEFEKTEWKPWGLPYKIPTYFMLHNWGMRFCDAALNSSLIADLLSSPLRYDLIILEHFANDCMTAVAHLLNAPVIALSSCAIMPWHYKRMGTPHINPIMPMNFLTYTDEMGLVDRLNNFIHFHTVNILYEWITQPATDELISQRFGFGLPPVNEIVKNTSLMLINQHYALTGLRPYAPNVVEVGGLHIGPKKPLTPVLNKIMEDSLSGVIYISWGSMVDPSSLPDQKRRALFKSIAHMKDYTFLMRWKSGKPLPHDKPGNLFTFDWLPQRDLLCHPRVKAFISHAGLLGTTEAVHCGVPMLVTPFYGDQFLNAGTLAQRGFGVIVDFGDFDEHHITRGLQTILDKGFSDNVRRSARAFRERPQSPLELAIWWIEHVIDTRGGLLLEGRARHISWFVYNSIDVYLICLAIIAIPLITIWQLVRLLRRTLGVLKVVKNKKTKVQ

SEQ ID NO: 8685 - protein, 507 aa, Trichoplusia ni
MKFNKLLLLALSAMVNGVLTLNILAVFPYQGKSHFFVFHSYLKELARRGHNLTVISYFPQEKPIENYHDISLAGKAKILEDVFPIYRSYWGMIQVSLFVTNSGTENCKVLLADENVQNLWKNKVKFDLVVVEMFNSDCTLGLAHALGAPVVGLTSCNLMPWHYKPFGIQYNPAYVSFMFSEGGTKPTLYQRIERTIFQTYLTTLYKYNSQRVDQRTLAQYFDNVPPLEELSRDIKFVLLYSHFVLTGPNLYPPNVQEVGGYHVAEAKPLREDLKKFIEESEHGVIYISFGSMLRATSTPKDKLEAIIGAISELPQRVIWKWEEKTLPGNPKNIFLSNWLPQNDILAHPKVLAFYSHCGMLGTTEAMYHGVPMVGMPVFGDQPLNAAAVEESGLGVQIQVKDLTKESLLEKFRTVLDPAFRSKVKELSKLWKDRPQSAMDSAIYWTEFAARSKKYTFRSPASTVPLYQYLYLDVFAVLGGLLFVIINILKTIIPMLFQNSQKTKLKSK

SEQ ID NO: 8686 - protein, 536 aa, Lingula anatina
MEKALRLRMVLFVLIFLTSIHNIAEGATFVGICMPVKSQIIELDTLLVGLADKGHEVYLVMGEHPSVPPLPKNVIDSKVKLLTFKVRSPDFMDFEKPEVQKNGVFAFFDNPRERYIPIKGVAFVNNWTKILHGYFGDLLTDEDFDRKMTKLKPDMIIVNNAFAFAPTAYLFPYKYKIPYVTSAVLGPPESGVPQQASFLPSPITKYSDQMTFLQRTVNFMTHRFISIMTTHKISPDYYAKYLPNVIQKPFHQLVADSELFIITSKHPSIDYPQLALPNTIFAGGMMTRPGKPLPNELQNFMDGHKNGVVVVTFGSLAMYIPDQVIQKLLSAFSKIKYGVIWRYTGSKKLNLPSHVKVLPWLPQNDLLAHPNTKLFVSHCGNGGSYEALYHGIPVLGFPLMGDQFYNGYRGQHRGVAMVMDILYFTPEDLIENINTMIENSSYYTKAKKLSAIYRDQPWTPQQQAAYWIEHVLKHGGSYLRSPSAHMSWYQYYSVDVVVFLLSSFICIMVVCISCCKCLCRRCCKGKGSKQNKLKTR

SEQ ID NO: 8687 - protein, 508 aa, Spodoptera exigua
MKFNSIIVLFSALFSEVLSLNILGVFPYQGKSHFFVFAPYLKEIARRGHNLTVISYFPLKEPVDNYHDISLAGKTKILEDVFPIYRSYWSIIQISFFLTNSGQENCITLLDDENVQNLWKTKQKFDLVLVELFNSDCALGLAHKLGAPVVGLTSHVLMPWHYEDYGIHYNPSYVPVLFLEGGTKPTLYQRIERSIFHLYFVYLHKLTCRRNNQKTLAQYFDDLPPLDDLAKNVNMLLLYTNYVLSGPGLYPPNVREVRGYHVTKPKELPQGLKKFIEESEHGVIYISFGSMLRATSTPRDKLEAIIDAVSEIPQRIIWKWEEKTLPGNPKNIFISNWLPQNEILAHPKVLAFYSHCGMLGTTEAIHYGVPIIAMPVFGDQPSNAAAVEESGLGVQIQIKELTKETLLEKLRIVLNPEFRKRAKELSKVWHDRPQSPMDTAIYWTEYAARTANYTFRTPANSVPLYQYRMWDIMAVILTILFIIFYSIKTVISLVQKRREERFYEFKTK

SEQ ID NO: 8688 - protein, 536 aa, Salmo salar
MTVMGSCVALVPVLLLLSSLQPSSEAGRVLVYPVDGSHWLNMRILVEALHTQGHQVTVLRSSTSWYVAEHSPHYTSITVPQAQPQNIESQEFMAHFLKKSLEIQRGKGSPWAFLQFCGNLFSMLRQNQEMVAELVVTMFENQTLMRDLKEAEYDLVLTDPVFPAGVLVAHYLQLPLVLNVRWVLSGEGHFAIAPSPLSYVPQVFSRNSDQMNFAQRLNNIFYHCLSYYMYRYVSNPPYQAVCDRYFAPDEVDVISLIQGADLWLMRVDFVFEFPRPTMPNVVYTGGFQCKPSKPLPAALEEFVQSSGEHGVVVMSLGTLLGGLGPEMTEVIASAFARLPQKVVWRHLGESPLSLGNNTLLVKWLPQNDLLGHPKTKVFVTHGGTNGIYEAIYHGVPVLGIPLIFDQFDNMVRMKARGVAEVMEVTTLEVESLTQTLMDILDEEKPYRENMRRLSRLHHDRPIEPLDSAIFWLEFVMRHKGAAHLRSESYKMPWYVYHNVDVLALLLGSALLVLVLFVVSCMCLVRGLQKRRKSKLE

SEQ ID NO: 8689 - protein, 370 aa, Phreatobacter stygius
MKIAQIAPLCERVPPRFYGGTERIVSYLTEELVRQGHDVTLFASGDSVTSANLVRCSDMALRLNPSVKDYLPYHVIMLDEVARRADEFDVLHFHIDILQFPLIRGLADRTVTTLHGRLDLPDMKPFYAAFPEVPLVSISQHQREPMPPALNWVGMVHHGLPPDLLTFNPTPSGDYLAFLGRISPEKRPDRAIEIALAAGVPLKIAAKVDKVDQVYWETVIEPMVTAHPSIDYIGEISEQEKAEFLGNARALLFPIDWPEPFGLAMIEAMACGTPVIAFRSGSVPEVVDHGRSGFIVDTIVEAAEAVPLASTLSRAGVRATFEARFTAARMAADYVDIYRALPGVRAEAARFRRRNGDGAGLHLVGSGALA

SEQ ID NO: 8690 - protein, 353 aa, Bradyrhizobium sp.
MRIAQLAPLAESVPPKLYGGTERVVAWLVDELVKLGHDVTLFASGDSRTTGKLHAVWPRALRLGRKGADPSAACAMLMEAIAKRARDFDVIHAHVDWLHLPLLSRLGVPFLTTLHGRLDLPGLPDVVRQFPDASFVSISDRQRLPLPDAKWSGTIQHGLPSELLRPFHEEGSYLAFLGRLTADKGPEDAIRIARAARMPLRIAAKIPRAETAYFKKHLEPQIDGETIQLVGEIDDVKKQPFLGGAAALLFPIDWPEPFGLAMIEAMACGTPVIAYRSGSVPEVIEHGLTGFIVENEEQAVEAVGRLRKLDRRRVRARFEQRFTARRMARQYEGRYRELVGAAAGKFDTERLEI

SEQ ID NO: 8691 - protein, 229 aa, Mesorhizobium sp.
VPTQRTGGWPMPPVRWVGTVYHGLPRYLLRFRPKASGYLAFLGRISPEKGPETAIEIAARTGMPLKIAAKIDKVDQSYWKERVEPQVLRNSNVEFIGEIDERQKADFLGNAAALLFPIDWPEPFGLVTIEAMACGTPVIAFRRGAVPEVIDDGVSGLIVETVDEAVDAVRRINGLDRAQVRRTFEERFTVERMCRDYVAIYGSLSEDITEALGSQNERAKNAAMMTMST

SEQ ID NO: 8692 - protein, 372 aa, Unknown
  Description of Unknown: Chloroflexi bacterium sequence
MSRSSSLRIAMLAPPMLPVPPPTYAGTERVVAALIDELVARGHRITLFGPGDSTVNCAIVPTPERSLWSTGYRGDVATYINITLARAWARAEEFDLLHSHVETLGFLFARYCPKPVLTTLHGRLDVSGVPRLLEEFKDIPLVAISDSQGRWWPDLNWIATIHHGLPLEGMPHSDEPGNYLAFIGRVTPEKGVADCIELARRTGLPLRMAAKVYDPHEKRHFEEIVQPAIDDGVVQFLGELAEPERDALYAGALATLMLGAWPEPFGLVAIESMAAGTPVIARRAGGPTETIEHGVDGFLVDDLTEAELAVSRVRALKRARIRKRAVARFSPARMADAYEAAYAFLLTGDGARRRGRAEEVRDGVPDKVSAKV

SEQ ID NO: 8693 - protein, 364 aa, Unknown
  Description of Unknown: unclassified Methylobacterium sequence
MKIAVLAHLKYPIGQPYAGGLEMHTHLLTVALKRHGHDVTLFASRGSDPALDPVMLCDPTGDALLDPEREEAIDREEEDAYRRMMEMVAAGGFDLVHNNALHALPLRESARLGLPWVTVLHTPPFDSLVGGVVQADPDMAFLAVSPSLAQEWAHLVPGAQVVDNGVDLSTFAFSHAADDTPFAFWSGRIVPEKGLHLAIDAARAAGLPLTFAGPKLNPGYWAAEIAPRLGPDLTHLGHLSHRDLAHHLGRARVAIVSPRWEEPFGLVVAEALACGTPVAAFRRGAMPDILDASCGRLARPDDPQDLSVAIREAAGLSRRACRDRAEALYDAAAMTGRYLEAYDAVIARCAERARPALRVAGGRG

SEQ ID NO: 8694 - protein, 359 aa, Arthrospira maxima
MPQKSWKLLFISTPVGPLGSGLGGGVELTLLNMAKALHSRGHDITVVAPSGSVLESLSVIEISGKLQPIAQNQDRDSLITIPENSVLGNMWEYGRQVQTNYHAIVNFAFDWLPFYLTPFFPTPIAHWVSMGSLISALDQIVVEVMKQFPGTVGFYSHTQAATFGSDLGYACLGSGLEMDRYQFCDQPHQQLAWMGRISPEKGLEDAIAAADKTGIPLAIFGKIQDEQYWQNILNTYPNAPLNYRGFLNTDELQQGLRECRGLLMTHRWVEAFGNVAIEALACGVPVISYRRGGPAEIVRDGETGWLVEPDSVTGLVDAIAKLEQIDRRQCRALAEKEYSLVALGDRLETWLSDVIALKN

SEQ ID NO: 8695 - protein, 333 aa, Unknown
  Description of Unknown: Actinobacteria bacterium sequence
MRIALLGPVAWRTPPRHYGPWERITGLLAEGLVARGVDVTLFATLDSVTAARLDGVCPHGYAEDPTMDGRVWEAMHIAHAFTRSVEFDLVHSHLDWLPLAFAGQCRAPLLTTIHGFSGAGILPAYARAASNYVSISDADRSPDLEYVATVHHGIDVAELPFTADAGTGLVAFGRIHPDKGTHTAIEIARLAGRRLTICGIVQDQRYFTEQVAPHIDGDRVVFLGSVGPERRAEVLGSSAALLHPIAFDEPFGLSVVEAMACGTPVVAYPRGSMPEVIDEGVTGFLVPDAEQASAAVKNIAAIDRAGCRTRARQRFSVDRMVADYLHVYATLLG

SEQ ID NO: 8696 - protein, 356 aa, Bradyrhizobium sp.
MRIAQVAPLTEAVPPKLYGGTERVVHWLTEELVTLGHDVTLFASGDSQTSGKLEATWPKALRLDGSVRDPNALHMVLLERVRQKCDQEEFDFLHFHLDYYPWSLFQRQPTPFVTTLHGRLDLPEHQPVFDTFPEVPVISISNAQRRPVPQANWVRTIHHGLPENLLTPQAVNPSYLAVLGRIAPEKGVDSAIKIAMRCGIPLKMAAKVDRADQEYYEAVIRPLIVDNPLVDFIGEISDREKPEFLSGAIALLLPIDWPEPFGLVMIEAMACGTPVIAFNRGSVPEIIEDGLTGFIVEDETSAVGAVGRLPALSRQTIRKRFETRFTARRMALDYLNCYRDLMEAAEPRIKLVASAE

SEQ ID NO: 8697 - protein, 331 aa, Unknown
  Description of Unknown: Alphaproteobacteria bacterium sequence
MRLDGSVRDPNALHMAVLEQVRQRAHDYDLLHFHLDYYPFSLFSRQSTPFVTTLHGRLDLPEHQVVFATFPSIPVISISDAQRRPVSRAGWIRTIHHGLPERLLTPQPITPTYFAFLGRISPEKAVDQAIWIAKRSGIPLKIAAKVDAVDRDYFESEIRKLLAPPDVEYIGEISDGEKSSFLSGAIALLAPIAWPEPFGLVLIEAMACGTPVIAFNRGSVPEIVEDGLTGFIVERKEEAIAATDQLSWLSRGAIRRRFEERFTARRMAREYLAVYRSLIDKRRPRRSTHHAGEFLAPSIAGAFAEKAALKKSRRSGTKVAFNGEVTRQRNQ

SEQ ID NO: 8698 - protein, 418 aa, Ktedonosporobacter rubrisoli
MKIAHIASSWIALPPQNYGGTEHVLAYLLEEQVAQGHDVTVFAPADAHTSARQVSFFPRSLLSSGTPWLAHLKAYYHLHKAVSLLSRLQAEIVHLHLSSPSDMYLFPLLASLSIPRLMTLHSCFPFDRIDSWVGDADDYYLHEWANSMPMVAISEQARRCAPAGLNFLGVVHHGLPMSRFPFSAQPPANYLAWLGRIAPAKGPHLAIEAARRAGIRLLLAGRVSQHIQEERRYFEEKIRPQLDGGQIRYLGPVDMAAKVELLGRARALLNPIEWEEPFGMVMIEAMALGCPVISFSRGSAPELVASGCNGFLVENVEQMAQAIGMLGQVDRRQVRRYAEEHFSVQVMASKYLSLYRQVLAEQGPNSLQNLLPASHIFTEPLMLPSRLSYQPSSQEPGASTGAISQTEKQQVQWLDNLA

SEQ ID NO: 8699 - protein, 356 aa, Unknown
  Description of Unknown: Alphaproteobacteria bacterium sequence
MRIAQVAPLTEAVPPRLYGGTERVVHWLTEELVALGNDVTLFASGDSRTSAKLDATWPKALRLDGAVKDPNALHIVMLERVRQKCDDEQFDFLHFHLDYYPFSLFSRQPTPFVTTLHGRLDLPEHQPVFTTFSSVPVISISDAQRRPVPHGNWIRTIHHGLPENLLTPQPVRPGYLAVLGRIAPEKGVDRAIRVAARCGIPLKIAAKVDRADQDYYDEMIRPMIEGSALFEYVGEINDSEKPDFLSGALALLVPIDWPEPFGLVMIEAMACGTPVIAYNRGSVPEIVENGLTGFVVENENGAVAAVDRLSHLSRHAVRQRFESHFTARRMALDYLAVYRSLMEAAEPPMKLVSSAE

SEQ ID NO: 8700 - protein, 364 aa, Rhizobium sp.
MKIAQIAPLAESVPPKLYGGTERIVSYLTEELVAQGHEVTLFASGDSVTRATLVSCADVALRLNPAVREHLPHQVVMLEEIRQRAHEFDVLHFHIDLLHFPLIRDFADRTVTTLHGRLDLPDLKPFYTTFPDIPLVSISNDQRRPMPPVDWRGTVYHGLPADLLPFTERPKGNYLAFLGRISPEKRPDRAIQIAAKVGMPLKIAAKIDNADKAYWENVIEPMIKSHSHVEFIGEINELEKADFLGNAGALLFPIDWPEPFGLVMIEAMACGTPVIAFGCGSVPEVIENGVSGILVDSVTEAAENVEWALRLDRRKVRAAFEKRFTAQRMAWDYLDIYRNLPGVRTKAAPIRRSNGQALDLQAVA

SEQ ID NO: 8701 - protein, 384 aa, Mesorhizobium sp.
MRIAQVAPLDESVPPHLYGGTERIVSFLTEELVRRGHEVSLFASGNSVTTANLVPQGTTALRLDPNARRSSIAAHLAMLDEVRRQQDRFDVIHCHLSHFQHFPLFETFAEKTITTPHGRLDYSDLPSTYARWPYFSLSSISMRQRQPLPKARWVGNVYHGLPLHLYPATDRAPPQDPYLVFLGRIYRDKRPDRAIEIARLAGMRLKIAAKMDYSNRAYCEELVEQMKSPHVEFLGEVDEIGKAALFAGAHALLFPIDWPEPFGLAMIEAMAFGVPVIAWPQGAVPEVVDDGVTGFVVDTIEDAVAAIQRAHSLDRRQVRRRFEERFSASRMVDGYEAIYASVAAGMYEPKDVPRIVSIAGKGRSDQEWTNGNQISLNSRRGSMN

SEQ ID NO: 8702 - protein, 375 aa, Novosphingobium sp.
MRIAIIAHLKHPIAEPFAGGLEMHTHLLARSLRDRGHHVTVFASACSDAALGLEAICSETALDEVGTAEAQDVAFFKEHHAYLTLMNALRHSSFDVVHNNSLHYLPVTLADSLPMPMVTTLHTPPFCWLESGVRLCSAKNHGFVGVSNAVAQAWSHVAHAEEIILNGIDLERFAFRPEADAGGYLVWYGRIVPEKGLHFAIEAAEKIGLPLRIAGPILDQEYYEKRIAPMLGASARYLGHLGHAELAVLVGGARTFLCTPAWDEPYGLVVAEALACGVPVAAFARGAIPEILDESCGVLAVPDDVLSLAGAGLAALSLQRRACRARAEHLCDARRMVGAYEAFYRRKIANQTEEARLDGITYPGVLPFVAGHPGV

SEQ ID NO: 8703 - protein, 368 aa, Sphingobium sp.
MRIAIIAHLKYAIGEPFAGGLEMHTHILARSLRERGHDVTLFASTRSDPSLGLEAICEETSLLETGTAEANDVAFFREHHAYLGLMTALRTRSFDIIHNNSLHYLPVSMSDTLAVPVLTTLHTPPFCWLESGIRLNRGSMTYVAVSEATAAMWRHVANAEYVIPNGIDLRHFPYQPIANREPYLVWYGRIVPEKGLDYAINASRLAGLPLKIAGPISNQGYFEKLIAPRLGGDIEYVGHLSHIELSKLVGGAVAALCTPRWEEPYGLVVAEALACGTPVAAFARGGVPSLLKPDCGVLAEPDNVSSLASAALAASALERSACRAYAERYCCSRRMVDEYEALYRRLAMAQVAIPNESDIGLLPVADVA

SEQ ID NO: 8704 - protein, 359 aa, Unknown
  Description of Unknown: Oscillatoriales cyanobacterium sequence
MTNNSLKLLFLSTSVGQLGSGLGGGVELTVLNIAKELQRRGHKITVVAPAGSVLESIPVIEIAGDLQVTAQTQDYHDPIVMPADSVLANMWEYARQVQDDWDLIVNFAYDWLPFYLTPFFNTPIAHFISMGSMSRSFDRIAGQIAVKFPGTLGVCTLTQAQTFAFASECELVGNGGIDLSLYDFCSQPEPKLAWLGRIAPEKGLEDAVAAAKITGIPLKIMGKMQDEDYWQKICTDYPDAPVEYLGFLTTTKMQEQVRQCRALLMTPRWVEAFGNVAIEALACGVPVIAYERGGPAEIVRDGLTGFLVEPDSVNGLVSAIDRLDKIDRSACRRQAEVEYNLGAAGDLFERWFKSIVKLS

SEQ ID NO: 8705 - protein, 363 aa, Pedobacter sp.
MKIGVISHLKHPISAPFAGGLEVFTHQVTNALTALGHQVTLFASSSSDPTLPLEAILSDDHYDQVSRTRKGQRNLPSEYIAEHHAYFGLMCKIDALGLDVIFNNSLHYIPITMANTIRTPMVTVLHTPPFYELELAIAAERRRPVMNYVTVSYQSAFNWQKLIAECPVILNGIMLQDWDFYSSPAKEQYAIWFGRIHPDKGLHLAIKAARSAGIALHVAGAISDKRYYDREIVPILDTDITLLGLLNQKQLNQEIGEASVCLITPCWQEPFGLVVAEAMACGTPIAGFNMGALPELVTAETGVLVEFGNVPALGNAICQAMGLERKRIHLHAVNRFDFHHMIAAYEQLLEDIIEEKRNLNYAI

SEQ ID NO: 8706 - protein, 346 aa, Unknown
  Description of Unknown: Methylobacterium sp. L1A1 sequence
MFRVAQVAPNIFPVPPLHHGGTERIVHDLSMALRGIGVDVTLFASSDSVTEISRIGDHPSLDALERRYGRVAPGVPAALDALQLEALRLRLPEFDIVHAHGEFAHAALLGERRRRSLTTVHWRVDELDRALFFAGFPDLPVAAISAAQEAGIPPANRAGIVHHGIAADRYALRCEPDGHVAFVGRMTDQKRPDIAIRVARAAGIPIRLGGTIDVGNPDYFEQRVQPLLGPDATYLGPIDDTAKGALLGGARALLFPIDWPEPFGLVMIEAMACGTPVIAWNRGSVPEIVEDGVTGFVVTSEDEAVEALARIGQLDRRQVRRRFEERFTAERMARDYLAIYQRLLAA

SEQ ID NO: 8707 - protein, 354 aa, Paraburkholderia sp.
MRIAQIAPLHEAVPPKLYGGTERVVSYLTEALVDLGHDVTLFASGDSQTSAKLEAFWPQALRLDPSIRDTMAPHMLLLEEVRRRADEFDVLHFHIDYYPFSLFSRQPVPHLTTLHGRLDLPELQPIFNTFNEVPVVSISDNQRMPLPQANWLSTVYHGLPENLLTPRKDIEPSYLAFLGRISPEKRVDTAIRIAEKAGMKIKIAAKLDKADRTYYEEQIKPLFALPHVEYIGEISEGEKAEFLGGAHALLFPIDWPEPFGLVMIEAMACGTPVIAFKRGSVPEVIENGVSGFVVEDELSAVAALKRLPSLPRETVRKAFEARFTSKVMAQNYLASYENLLRQKRRTVLREVAAG

SEQ ID NO: 8708 - protein, 346 aa, Methylorubrum sp.
MIRVAQVAPNIFPVPPEHHGGTERIVHDLSVALRSLGIDVTLFASSDSATDLPRVGDHPSLAALERRNRQVPPGVPAALDALQLEALRLRLDRFDIVHCHGEFAHAALLGPRRRQSLTTVHWRVDELDRALFFAGFPDLPVAAISAAQEAGIPVPNRAGVVHHGIAAERYAFRPEPGAHVAFVGRMTDQKRPDTAIRVARAAGLPIRLGGTIDVGNPDYFERSVRPLLGPDATYLGPVDDRAKGDLLGGARALLFPIDWPEPFGLVMIEAMACGTPVIAWNRGSVPEIVEEGVTGFVVASEAEAVAALARIGQLDRAVVRRRFEERFTAERMARDYIALYRRLLAA

SEQ ID NO: 8709 - protein, 362 aa, Unknown
  Description of Unknown: Alphaproteobacteria bacterium sequence
MRIAQIAPLTEAIPPRLYGGTERVVHWLVEELVALGHDVTLFASGDSCTSAKLEAFWPRALRLDGSIRDPNALHMAMLEQVRRQADDFELLHFHLDYYPFSLFSRQATPFVTTLHGRLDLPELQPAFDTFSSIPVVSISNAQRRPLPQAHWMKTVHHGLPEKLLMPMPAKPSYFAFLGRIAPEKRVDRAIRIAEHCGIPLKIAAKVDRADIDYYEQEIRPMLASPNVEYIGEIGDKDKPEFLSGALALLVPIDWPEPFGLVMIEAMACGTPVIAFNRGSVPEIIDEGVTGFIVEDETGAIGAVDRLSHVSRAGVRKRFEERFTARRMALDYLSVYRSLTVVHAPHLRLVSEEDVPVAAASGS

SEQ ID NO: 8710 - protein, 348 aa, Unknown
  Description of Unknown: Betaproteobacteria bacterium sequence
MRIAQIAPLAEAVPPKLYGGTERVVSYLSEELVRLGHDVTLFASGDSETSARLVACAPRALRLDPAVKDPLAPLALMLERVRAQAHEFDILHFHLQHVHLPVFRPLARRTVTTMHGRLDPPELAPLYREFSEMPLVSISTAQRRLLPFANWIATVHHGLAREVCPFNPGPRGSYFAFLGRVSPEKGLDRAIETARRAGVRLRIAAKVDPCDEEYFQREIVPLLGLPGVEFVGEVNEAQKPAFLGNATALVFPIDWPEPFGLAMIEAMSCGTPVIAWAQGSVPEVVEEGRTGFIVDSMEGAVAALEKAARLDRLEVRNRFEERFSAARMAQDYLSVYRALGRRRAVAAL

SEQ ID NO: 8711 - protein, 698 aa, Polyangium sp.
MALTVLNVAYPLAPVGWDAVGGAEQILTAIDSALVRAGHRSLVIACEGSRCEGELISTPLPDGPLDEAARRQAWANHRAAMARTMERNRIDVIHLHGVDFHEYLPPPGVPALVTLHLPPAWYPAEVFDLSRPSTHLHCVSRTQRAACPPHARLLEDIPNGVPLDRLRPSKKSKEGFALVLGRVCPEKGIHLALRAAKRAGMPLRVAGRVFPYAVHERYFREEIVPLLDPDRMFLGPVGLAQKAKLLAEARCVVIPSLVPETSSLVAMEALACGTPVIAFGKGALPEVVEHGRTGFLVNDEQQLVEALENVESIDPAQCRAAAEERFSLEAMCGRYLGVYERLTRRVAAPRLEWQLVTSPRALLELREAWAALWSRCPNATVFQHPDWVLPWCEHLFSGELFTLCLRTGGRLAGVALMHRWHDGAERVLSMLGAGHSDYHDLLIEPEMAQAAKEALSAWLDAHADQWDRIEVSELRPGCPLLDLEPAGAIALVEEQDACPVLMLSADGGLEEQVPPRMAGNLRTARRRAEQMGEVSFESVRPDNLDELLDALLGLHASRWQERGDTGVLSADAVQRFHKDVARGFLGRGMLAFEVLRIDRKIVSVLYGFYDHQALRYYLGGFDPAFARASVGSLVLARAIEQALGRGVKEFDFLRGREPYKYAWGASDRPILRWRLVRNTKCGNPLETSSTDSSCRRAS

SEQ ID NO: 8712 - protein, 364 aa, Rhodoligotrophos sp.
MRIAQIAPLAESCPPKLYGGTERIVSYLTEELVRQGHDVTLFASGDSRTSAKLVPCCEMGLRLDKSVMDILPYHVIMLDEISRRADEFDVLHFHTDFIHYPLIRPLADRCVTTLHGRLDLPDLKPLYAAFPELPLVSISYDQRRPMPPVNWVGTVYHGLPRDLLPFTSRPKGNYLAFLGRISPEKRPDRAIEIAGRAGIPLKIAAKVDKADQAYWHSTIAPLIAMHPNVEFVGEINDNQKADFLGNARALLFPIDWPEPFGLVMIEAMACGTPVIAYPCGAVPEIIDDGISGFVVQSIPEAVAAVRHVDKLDRGEVRATFEERFTATRMAEDYLAIYRALPGVRTAVEPMPRVAGREFGLHVVA

SEQ ID NO: 8713 - protein, 263 aa, Unknown
  Description of Unknown: Chloroflexi bacterium sequence
MRVAMLAPISWRVPPRHYGPWERVVSLLTEGLVERGVDVTLFATADSVTQAHLDAVCPRPLEEDASLDAKVWESLHIANVFEKAVHFDLIHNHYDFLPLTYAGLVSTPVLTTIHGFSSDRIKPVYRRYAGRVAYVAISEADRDPDLPYLSTVYHGIDLSEFTPRESAGRGLVFFGRIHPDKGVADAIAVAKAVGLPLVIAGIVHDRVYFEREIAPHVDGDRVRYVGSLGPAERDELLGSALALLHLVEFAEPFGLSMIEAMAC

SEQ ID NO: 8714 - protein, 341 aa, Pedobacter sp.
MKIAIIVNPLIPVPPEKYGGIERIVYMLIQELKSFGHDITLFAHPDSAAGCKLVSYTGSEYFNFKDFVKINAITAKIIFNQFDIVHTFGRMSNIALLMPSKLPKIISYQLPPTLSQIKKAIKLSRKNSLHFTGCSDYIANQIRTLTPASTIYNGVNINDYTFSQMVIEDAPLFFLGRIQVDKGTHIAIDVAKRTNKKLIIAGNIPNEQIHQDYFKAYVEPFIDGEQISYIGPVNDQQKNNLLGKALAFLMPVTWDEPFGIVMVEALACGTPVIGFRRGAIPEVIKDGINGFICDEVTDMVNAVHKVDKISRKACRDVASEKFRSTKLAKQYEHLYLTAITQ

SEQ ID NO: 8715 - protein, 413 aa, Ktedonosporobacter rubrisoli
MKIAHIAPSWITLPPQNYGGTEHVLAYLLEEQVAQGHDVTVFAPADAHTSARQVSFFPRSLLPSGIPWSAHLKAYYHLHKAVSLLSRLQAEIVHLHLSSASDMYLFPLLASLSIPRLMTLHSCFPFDRVDSWVGDADHYYLREWANSMPMVAISEQARSHAPVELNFLGVVHHGLPMSHFPFSAQPPANYLAWMGRMVPEKGAHLAIEAARRAGIRLLLAGTIDRHVPGEMRYFEEKIRPQLDGEQARYLGPVDMAAKIELLGRARALLNPIEWEEPFGMVMIEAMALGCPVIAFSRGSAPEMVAPGRSGFLVENVEQMAQAIGMLGQVDRRQVRRYAEEHFSVQVMASKYLSLYRQVLAEQSPVALHLLLPASCTAKETPLLPTSIQIGEPAQAVTWPSHQARVALGEESAS

SEQ ID NO: 8716 - protein, 355 aa, Unknown
  Description of Unknown: Bradyrhizobium sequence
MRIAQVAPLTEAVPPKLYGGTERVVHWLTEELVTLGHDVTLFASGDSQTSAKLDATWPKALRLDGSVRDPNALHMVMLERVRQKADDEEFDFLHCHLDYYPWSLFARQPTPFVTTLHGRLDLPEHQPVFNTFSKIPVISISNAQRRPVPQAHWVRTIHHGLPENLLTPQPAKPSYLAVLGRIAPEKGVDRAIKIATRCGIPLKIAAKVDRADQEYYDELIKPLITSNPLVEFIGEISDREKPDFLSGAIGLLVPIDWPEPFGLVMIEAMACGTPVIAYNRGSVPEIIEDGLTGFIVEDEISAISSVGRLGTLNRDAIRKQFETRFTARRMALDYLAAFRSLMEAEPRFKLVASAE

SEQ ID NO: 8717 - protein, 335 aa, Nonomuraea sp.
MRIALLGPVAWRTPPRHYGPWEQVTSLLAEGLSAAGVDVTLFATLDSVTSGALDGVCPRGYANDPTLDGRVWEAMHVAHALSRSGEFDVVHSHLDWLPLAFADHCRAPLLTTVHGFSGMGILPAYVRARSAYVSISDADRAPELDYVATVHHGIDLDAFPFDPVGGRRLTAFGRVHPDKGTHRAIEIARRAGMPLTICGIVQDERYFEEEIVPKVDGEQVSFLGSVGPERRGQILGGAAALLHPIAFDEPFGLSVVEAMACGTPVVAYRRGSMAEVVDPGVTGFLVDTLDEAVTAVARIATIDRASCRAQAQRRFSADRMVASYLRIYREMLGQS

SEQ ID NO: 8718 - protein, 353 aa, Mesorhizobium sp.
MKIAHVAPLYESVPPRLYGGTERIVSYLTEALVDLGHEVTLFASGDSQTSATLLASRERALRLDSRPLKSEIAAHLSMLAQVRDRASEFDVIHFHLSHFLHFSFFEDLADRTVTTPHGRLDYVDLAPAYERFPRFPLISISHSQKAGLAKANWLATIHHGLPTTLYEPTFETTAEEPYLAFLGRFSRDKRPDRAIEIALRSGLKLKLAAKIGDDDRAYFHEVVEPLIDGDRIVYVGEIEEDQKAEFLGKAAGLLFPIDWPEPFGLAAIEAMACGTPVIAWNCGALSEIIDQGVTGFIADTMDGAVAAVPDLLQLDRRKVRAVFEKRFSARRMAGDYLAAYARLIGVPTEAKAS

SEQ ID NO: 8719 - protein, 354 aa, Mesorhizobium sp.
MTLTVLNVAYPLAPVGPDAVGGAEQVLSMLDQALVRAGHDSIVIGCQGSKAAGVLIETPAEPGVLDDAAKKRAQRSHRVAIEVARARWPIDVVHLHGIDFDAYLPDDGPTLVSLHLPLDWYPADALRPVRDDLWLHAVSVAQQRTAPPGARLVAPIPNGVDLDALSGRQSKRNFALVLSRICPEKGIHLALDAAKQAGVPLVIGGKVYPYQTHTLYFRDEVQPRLDKRRRFLGPLGFTAKRRFLNAARCLVIPSLAAETSSLVAMEALACGTPVVAFPNGALPDVVEHGRTGFLVNDVGEMAEAIVAASRLDPEICRAEARRRFSLARMISSYMDAYHALAGLGASRRGLAAAQ

SEQ ID NO: 8720 - protein, 289 aa, Mesorhizobium sp.
MMLEQVRRRADEFDVLHFHIDILHFPVVRDFAERTVTTLHGRLDLPDLAQLYAMFDDIPLVSISYDQRWPMPPVHWIGTVYHGLPRDLLPFRPKASGYLAFLGRISPEKGPETAIEIAARTGMPLKIAAKIDKVDQSYWKERVEPQVLRNSNVEFIGEIDERQKADFLGNAAALLFPIDWPEPFGLVTIEAMACGTPVIAFRRGAVPEVIDDGVSGLIVGTLDGAVDAVRRISGLDRARVRRTFEERFTVERMCGDYVAIYGSLSDDITKALGSQNKRAKNAAMMTMST

SEQ ID NO: 8721 - protein, 352 aa, Rippkaea orientalis
MLKLLFISTPVGSLGSGIGGGVELTLKNLAIEMNRRGHQVTVLAPESSILPNIDLIQIAGQCQQMAQAERRRNSIALLHNSVLGNMWDYARTIQYNYDIITNFAYDWLPFYLTPFFKRPIAHLVSMSSINPAFDQIITQVAQNFPKTIGVHSKIQAETFPFAASCRILGNGLDLSLYQCCLDPGESLGWVGRIAPEKGLEDAVAAAQITGIPLKIFGKMEDKSYWQQISQDYPHAPVDYQGFLSTFELQEQLGRCRALLMTPRWVEAFGNVVMEALACGVPIIAYRRGGPAEMVREGETGFLVEPDNITALVANIERIDTISRHRCRQQAEQEYSLNAFGDRFEKWFIELKK

SEQ ID NO: 8722 - protein, 369 aa, Unknown
  Description of Unknown: Methylocystaceae bacterium sequence
MIMKIAQIAPLIESVPPRLYGGTERIVSYLTEELVEMGHEVTLFASGDSLTSANLVPCVPMALRLDKQVHDTIPYYMLMLDRVRQQAHNFDILHFHVDFFPFPLFRSIARRTVTTLHGRQDLPDLPPFYSAFDDMPLVSISEAQRSPLPKDSFAATIYHGLPLQLHRPTFDPRGGYVAFLGRISPEKGPERAIQIAQTLGIPIKIAAKIDKIDEDYFRECIFPLLNGPGIEFIGEINERQKTQFLGEALALLFPIDWPEPFGLAMIEAMACATPVLAFQRGSVPEIIDDGVTGVIVDGMEQAATALPRVLGLDRRAVRRRFEERFSSALMAKNYVNLYRSLLIPVSPVVSSGERDSALPKLHDIPGIAH

SEQ ID NO: 8723 - protein, 349 aa, Unknown
  Description of Unknown: Candidatus Eisenbacteria bacterium sequence
MRIAQIAPLYESVPPKLYGGTERVVSYLTEELVREGHEVTLFASGDSVTQARLVAGSRQALRLDKRCIDQLAHHVVMLERAYRDTRRFDLIHAHCDYLHFPFARRQKTPVMTTLHGRLDIPDLVPLYREYPEMPVVSISNAQREALPWLNWRGTVYHGLPAGLLRFHERPGKYLAFLGRISPEKRVDRAIEIARRVGMEIKIAAKVDPVDREYFQSVIAPLLSWPKAEFVGEVGESEKDEFLGNAYALVFPIDWPEPFGLAMIEAMACGTPVVAFRRGSVPEVVDEGVSGFIVDHLQDAARAVERVASLSRRGVRAAFEERFSAARMARDYLSLYERLVQGREDLSLVG

SEQ ID NO: 8724 - protein, 236 aa, Unknown
  Description of Unknown: Calditrichales bacterium sequence
VVTTIHGFSSPGILPVYKKYNGKVFYVSISDADRSPDLDYIKTIHHGLDINQFDFQLEPDDYLIFFGRIHHDKGPKEAIEIATACNKKLVLAGIIQDEAYYKKYIVPHLDNSNVVYAGSAGPVQRNQLLGKATALLHPINFNEPFGLTVIESMACGTPVIAFNRGSMPELIENGKNGFLVNTIGEAIAAVGRVKDINRAYCRHRVEQYFTINRMVEEYIQVYGMILDKRKGQKYRE

SEQ ID NO: 8725 - protein, 346 aa, Unknown
  Description of Unknown: Methylobacterium sp. BK227 sequence
MLRVAQVAPNIFPVPPDHHGGTERVVHDLSTALRSLGVELTLFASSDSATDLPRVGDYPSLAALERQYGRVAPGVPAALDALQLEALRRRLDAFDIVHCHGEFAHAALLGGRRRHSLTTIHWRVDELDRALFFQGFPDLPVAAISAAQATGIPASNRAGIVHHGIDRTRYSLRAVPDDHVAFVGRMTDQKRPDVAIRVARAAGLPIRLGGTIDVGNPDYFDRRVRPLLGTDATYLGPVDDARKGELLGGARALLFPIDWPEPFGLVMIEAMACGAPVVAWERGSVPEIVEDGVTGFIVSTEAEAVEALARIGQLDRATVRRRFEERFTAERMARDYLALYQRLRAA

SEQ ID NO: 8726 - protein, 343 aa, Pedobacter sp.
MKIAIIANPLIPVPPTQYGGIERIVYMLIQELISSGHEVTLFAHPDSEPNCELIGYTGSEYFNLIDFFKINYITSKILFNTFDIVHTFGRMSNITMLMIAKLPKVVSYQLPPTLNQIKKALKLSRKNTLYFTGCSDYIANQIRTLTPTSTIYNGVNINDYTFSQTATEDAPLFFLGRIQVDKGTHIAIDVAKRTNKKLIIAGNIPNEQIHQDYFKEFVEPFIDGVQISYVGPVNDQQKNNLLGKALAFLMPVTWDEPFGIVMVEALACGTPVIGFRRGAIPEVIEDGINGFVCDGVTDMVNAVHKVDKINRKACRDVASEKFSSTKLAKQYEHLYLTAIPNKN

SEQ ID NO: 8727 - protein, 350 aa, Unknown
  Description of Unknown: unclassified Bosea sequence
MRIAQIAPLAESVPPRLYGGTERVASWLTEELVRQGHRVTLFASGDSQTSAELVACAPQGLRLAGIRDHTASHLAMLAKVRERQESFDVIHFHLDLLQHAMFSDLTHKCVTTLHGRLDLPDFLPVYQAFPRMPLISISDGQRTPMPSTANWLATVHHGLGPGLCPFEARGGDYLAFLGRITPEKRPDRAIEIAKRAGMRLRIAAKVDAVDEEYFRSQIEPLLDHPLIEFIGEIDEAQKAGFLGGARALLFPIDWPEPFGLVMIEAMSAGTPVIAWRNGSVPEIVRDGVSGIIVDSIAEAVSACERSTAMDRSKVRAHFEQHFTAERMARDYLEAFGRLLSSPQGYTKAAE

SEQ ID NO: 8728 - protein, 350 aa, Parashewanella sp.
MKILIISTPVQAIGQGEGGGIDITLLNIINALSPLGHQFTVLAPTGSKLSADATLIEISGRLQTSVQTESASTPATMSHDSTIVSMCRYAQTHQDQFDVILNMAYDWLPIWLTTFFTTPIHHLVSMSNENQTVADAIEELNRMMPQRIAFHSHASANTFQLENPVTIIANGFEFTNFPFCKSPKQQLAWVGRISPEKGLENALEVANKVNLPLHIWGKVQSESYQQQLVEKFPEVDIHWRGFVPQQQLLKEMSQSALMLMTPSWIEAFGNNVVEANACGVPVIAYNKGGPTETVISGVTGYLVENNEDMANRVADALKLSRYHCRDSAQQRFSIEQYALKLQSWLSLNID

SEQ ID NO: 8729 - protein, 328 aa, Moraxella caviae
MKILHVLLTRLAIPPKDYGGTERVIWALAVAQRQMGHEVRFLTKANPNNNPDVQLYDKSKSIAEQIDDWPDVVHFHWPYDGELHKPYICTEHSNAEKAQEYPINTVFLSSKHAENHGATCYVHNGLYWADYSEPNLDNPKDYVHFLAKAAWRVKNLQGTIDIAKQAGKRLEVIGGKRFNLSRNPYFYLSPNIGFNGMVGGVAKDNLIKNSKGLIFPVLWHEPFGLAIIESMYLGCPVFASPFGSLPDIISHDGLGVLSDSYSELAEAVKQVDKYDRRVCHEHAKTHFGHEAMGRAYQKCYERVIAGETLNPTRPKSTGNVKALLEMKP

SEQ ID NO: 8730 - protein, 330 aa, Unknown
  Description of Unknown: Alphaproteobacteria bacterium sequence
MKIAQIAPLYEAVPPSLYGGTERIVAHLTNALVELGHDVTLFASAEANTRATLVPVRDQAIRLDRFPLKSDLAAHLSMLHELHLRRHEFDLLHFHVDLIHFPFFEDLAARTVTTLHGRLDLKDLPEVYSRWRDYPLVSISDDQRKPLASANWLATIHHGLAEGVYSFNETPSDPYLAFLGRISPEKRPDRAISIAKRLGIRLKIAAKVDAVDVGYFHDEIKPLLADPLIEFIGEIGDSEKSAFLGNAAALLFPIDWPEPFGLVLIEAMACGTPVIAWRCGSVSEIIENGKTGFIVDTEDEAVGAVLKLDQLDRRMVRKVFQERFTADVMA

SEQ ID NO: 8731 - protein, 364 aa, Rhizobium laguerreae
MKIAQIAPLAESVPPKLYGGTERIVSYLTDELVRQGHDVTLFASGDSVTDARLVPCSDVALRLNPAVKDHLPHQVVMLEEVRRRAHEFDVLHFHIDLLHFPLIRDFADRTVTTLHGRLDLPDLRPFYMAFPDIPLVSISNDQRRPMPPVKWVGTVYHGLAADGLPFTAQPKGNYLAFLGRISPEKRPDRAIQIAAKAGMPLKMAAKIDDADKAYWQTVIEPMVKSHPNVEFIGEINEHQKAEFLGNAGALLFPIDWPEPFGLVMIEAMACGTPVIAFSCGSVPEVVDSGLSGIIVDTVTEAVENIEWALRMDRRKVRETFEKRFSAKRMASDYLDIYRSLPGGRTEAARMRRPNRTVPDLQVVA

SEQ ID NO: 8732 - protein, 353 aa, Mesorhizobium sp.
MRIAHVAPLHESVPPRLYGGTERIVSYLTEGLVELGHDVTLFASGDTRTSAKLVPCRERALRLDPRPLKSETAAHLLMLSEVKKRAQQFDIIHFHLSHFLHFSFFSHISERTVTTPHGRLDYVDLAPAYERFPRFPMISVSRSQRMGLANANWLATIHHGLPTDIYEPTFETDRGEPYLAFLGRMSRDKRPDRAIEIAQRSGLKLKLAAKIGDDDRAYFHKVVEPLIDGDRVDYVGEIEENKKAEFLGKAVGLVFPIDWPEPFGLAVIEAMACGTPVIAWNAGAMPEIVDQGVTGFIVDSIEGAVALVPGLRRLDRRKVRAMFERRFSAKRMARDYVAAYACLIGASAEARAS

SEQ ID NO: 8733 - protein, 348 aa, Unknown
  Description of Unknown: Deltaproteobacteria bacterium sequence
MLRIAQITSVSIAVPPSTHGGTERMVYQLTEGLVRRGHAVELFASGDSRVSCPLHSVTPTALLDRPDWSTYLEREYETMNAFQLFRQAERFDLIHGHWPCLAPYFSRFTQTPMSLTYHYISPELLEFYETHFPRCHGVFVSHAQAVGLNRPHGRVIHNAVHGEDIPCGDGAEDRLIIVARMVPNKGIAEAIRIAQRAGKPLLVIAPVMHNFAESPVYFREIVEPLIDGKEVQYIPALPNDLALREVGRSRAFLFPLQWEEPFGLAVLEAMATGTPVIAYRRGGMPELVEDGVTGFLVDSEDEMLAAIREVGKLDRARCRERTLARFSGERMVSAYEQLYDKILASHRT

SEQ ID NO: 8734 - protein, 451 aa, Unknown
  Description of Unknown: Syntrophobacterales bacterium sequence
MHIAMLSPIAWRTPPRHYGPWESVVSLLTEGLVARGVDITLFATKDSITKGRLHAVCKKGYEEDVHAEPKVVECLHISELFDRAGDFDIIHNHFDFLPLTYSGLVKTPVVTTIHGFSSPRILPVYEKYNGKVFYVAISEADKAAGLDYIRTIHHGIDLDEFTFNPEPQGDYLLFFGRIHFDKGAKEAIEIARRSKKRLIMAGIIQDEVYYKREVEPHLDSDGITYVGSVGPEKRDALLRDASALLHPINFNEPFGLSVTEAMACGTPVIAFNRGSMPELIRDGVNGYLVSTVEEAVHAVGRLGDINRADCRKFIEENFSVERMVTDYIKVYEEIIEKIKPEERRHWGYYEVFIDDPDHKVKRIVVYPGKRLSLQRHRRRSEHWHVIYGEAVVTLDDQEIILKAGDSIDIPLGGVHRMANRGKENMALGEVQRGDYFGEDDIERLEDDFGRN

SEQ ID NO: 8735 - protein, 372 aa, Novosphingobium sp.
MRIGIIAHLKYPIAEPFAGGLEMHTHLLARTLRDRGHAVTVFASVRSEFGLGLEAICTETSLDDVGTAEATDVAFFKEHHAYLSLMNGLRDRDFDIIHNNSLHYLPVTLADTLPMPMVTTLHTPPFCWLESGIRLCKANDHAFVAVSKSVGQLWEHVAKAEEVILNGIDLDKFSYQPQPDPNAYLVWYGRIVPEKGLHFAIEAARQIGLPLRIAGPILDREYYRMHIAPQLDANIIHVGHLDHTELARLVGGARAFLCTPLWDEPYGLVVAEALACGVPVAAFARGAIPEILDASCGALAEPDNVASLAEAGLAALRLERSACRQRAERTCDAARMVDGYEALYRHRISLRHPGPAEVFAACQPIAPAARHA

SEQ ID NO: 8736 - protein, 356 aa, Unknown
  Description of Unknown: Alphaproteobacteria bacterium sequence
MRIAQVAPLTEAVPPKFYGGTERVVHWLTEELVALGHEVTLFASGDSRTSAKLDATWPKALRLDGSVRDPYALHMVMLERVRQKCDDEEFDFLHFHLDYFSWSLFSRQPTPFVTTLHGRLDLPEHQPVFNTFPSAPVISISNAQRRPVPQANWVRTIHHGLPENLLMPKPVSRDYLAVLGRIAPEKRVDRAIEIATRCGIPLKIAAKVDRADQDYYDELICPLITRNPLVEYIGEISDHEKSDFLSGAIGLLVPIDWPEPFGLVMIEAMACGTPVIAYNRGSVAEIIDEGLTGFVVEDEISAVARVDRLAGLDRGAIRKQFEARFTARRMALDYLAAYRGLMEPAEPRIKLVSSAE

SEQ ID NO: 8737 - protein, 377 aa, Unknown
  Description of Unknown: Methylobacterium sp. AMS5 sequence
MRIAQVAPLAEAVPPKFYGGTERVVSWITEELVRQGHDVTLFASGDSQTSAKLAACHPEGLRLLGYRDHTAGHLAMLHHVHRRAHEFDVIHFHIDLLQYPMFEDLYHKCLTTMHGRLDVPDFMPVYNTFTGMPLVSISDNQRDPMPESSNWLATIHHGLPKQNCPYYPEAKGGYLAFLGRISPEKRPDRAIEMAIRSGTPLKIAAKVDKADQEYWDEKIEPMIHHPLVEYIGEINEEQKKDFLGNALALAFPIDWPEPFGLVMIEAMSAGTPVIAFGNGSVPEVIKDGVSGFIVNSMDEAIEACRKVKDLPRAGVRAHFEGRFTAEVMVRKYVSTYEQLLAGQGNVIKMPAAGAFSPQYGELNGSAHGPIHVAAMPA

SEQ ID NO: 8738 - protein, 362 aa, Unknown
  Description of Unknown: Candidatus Jettenia ecosi sequence
MRIAQVAPLIERVPPEMYGGTERVVYYLTEELVKRGHKVTLFASGDSVTSAKLVPIHEKALRFDPDIENCYPYHMLELGIVYDRAREFDLIHSHMDFMTFPFTTLVSTPTIHTLHGRLDIPDIHKIYKHYRNCNFISISNAQRKFIPDLNWIDTIYHGYPLEKFPFNQEPEDYLVFVGRISPEKGPVEAIQTAKKAQKKLIIVAKVDPVDRNYYEEKVKPLITPPLIEYVGEKTEEERNEIMKKAKALIFPLDWPEPFGLVIIESLACGTPVITRNRGSIPELMIHGKTGFICETWEEMADAVQNLKDIDRRACRRHTEDNFSISHMVSRYEKAYELITSNNRPKILPLRLDRGSAKSQVTP

SEQ ID NO: 8739 - protein, 356 aa, Microcystis viridis
MSRKLLFLSTPVGFLGSGGGGGVELTLYNLARTLTRQGYPVRVVAPEASQLHDIPLITIAGNAQISAQSQGRQAPILMPENAVLANMWHYAQQVQNQYDLIVNFAYDWLPFYLTPFFATPVAHLVSMASVSLAMDHIIEKTYSNFPHLLAFHTLAQAETFSLSPPYRCLANGLDVSLYQFRDDPSPCLAWVGRIAPEKALEDAIAACQQLGVPLRVFGHISDPLYWQNLQDTYSFDLVDYRGFLPTGSLQKELGDCFGLLMTPRWVEAFGNVAIEALACGVPVVAYRRGGPVEIIEEGKTGFLVEPDSIEGLVTGIKNLDRIDRYSCRAVVEQKYSLEALANRAINWFEEIFARKK

SEQ ID NO: 8740 - protein, 358 aa, Synechococcus sp.
MKLLVVATALGPVGSGRGGGVELTLAGLVAGLLQRGHRITVLAAEGSGLPADCASAELWTCAGTPQPSVQHQGRDAAITMPLDALLARFWQRVLLEAPAHGFDAVLNLGYDWLPFWLTSSAPLPLLHLVSMGSVNAAMDGVIADVAAWDQRRLAFHTAAQAADFALVQPPVLLGNGFDLSAYRFCEQPDALLGWVGRVAPEKGLEDAAAAAARCGLPLAVWGLVEDEAYAAAVQASVPAGTLQWRGFLPTAQLQEALGRCQALLNTPKWNEAYGNVVVEAMACGVPVVAYRRGGPGELVQPGVNGLLVDPDDVEALADAVTEVKRIDRRACRQWVEAHASRAVLAERIEAWVEQALQP

SEQ ID NO: 8741 - protein, 351 aa, Reyranella sp.
MRIAQVAPLTEAIPPKLYGGTERVVSWLTEELVALGHDVTLFASGDSQTKARLEPVWPRALRLDGKVRDPMALHMAMLEHVYQRADQFDILHFHLDYFPFSLFSRNATPFITTLHGRLDLPEHQVVFDVFNRAPVISISDAQRQPVPNAHWIDTIYHGLPADLLQPRPAKPGYLAVLGRIAPEKAVDRAIHIARRAGMPLKIAAKVDPVDRQYYEHEIRPLLELPGIEYIGEISDAQKSDFLGGAVGLLMPIDWPEPFGLVMIEAMACGTPILAYPGGSVPEIVEDGLTGFIVNNEAEAVDAVRRLPELSRARIRARFEERFTARRMAMDYLSVYRRMAESDAPRLRVVTA

SEQ ID NO: 8742 - protein, 353 aa, Camelimonas lactis
MKIAQIAPLAERCPPKFYGGTERIVSYLTEQLVDMGHDVTLFASGDSVTAAQLRGCSGMALRLDPDVQEQLPWHLAMVDRVRRQAREFDVLHFHVDLLHFPIFRDIAHKTITTLHGRQDLPDLPPFYRQFPEFPLVSISHAQRTPMPAGVTWAANVYHGLPERLLTPQNSPDGDYLAFLGRISPEKRPDRAIAIAARAGMPLRMAAKIDRADACYWAETIEPMVRACDCVTFRGEIGETEKPEFLGNARALLFPIDWPEPFGLVMIEAMACGTPVIAWPCGSTPEIIDHGVTGFLVNSIDEAVAAVRMAGELDRDKVRARFEQRFSAARMARDYLAVYERLTNARPAAPLLIA

SEQ ID NO: 8743 - protein, 364 aa, Rhizobium laguerreae
MKIAQIAPLAESVPPKLYGGTERIVSYLTEELVAQGHDVTLFASGDSVTDARLVPCSNTALRLNPAIKDHLPHQILMLEEIRRRAHEFDVLHFHVDLLHFPLTRYFADRTVTTLHGRLDLPDLWPFYKAFPDIPLVSISNDQRHPMPPVNWLGTVYHGLPASLLPFTEKPAGGYLAFLGRIAPEKRPDRAIEIAAKVGMPLRIAAKIDNVDKHYWETVIRPMVMSHPNVEYIGEINDRQKAGFLGNAGALLFPIDWPEPFGLVMIEAMACGTPVLAFRSGSVPEVIDDGISGILVDTVAEAVENIEWALQLDRRKVRANFERRFTAGRMARDYLAVYGQLHGLRAKAPQRRRANRPISIDQVVA

SEQ ID NO: 8744 - protein, 357 aa, Sphaerospermopsis reniformis
MSQPTYKLLFMSTGVGALGSGLGGGIEVTLPNIVKAMQQRGHTIDIVAPAGSRSGSLPLIEIPGNTQNAAQDQKYDAEIGIPTNSVLANMWSYAYQVQGNYDLILNFSYDWLPLYLTQFFPRPVAHLISMSSLLNAMDDMIAKVATQFPHAIGVHSKTQAATFPCPDECVCLFNGLDLSLYQFCDQPGNSLGWVGRIAPEKGLEDAVAAANTLGMPLKIFGLMQNEEYWQQVRQAYPDAQIDYQGFVSTNELQAGLRECQAMLATPHWIDAFPTVGLESLACGVPVIAYSRGGLVEIVEDGKTGFLVEPDSIQGLIDAVKRVHTIDRQNCRQQAESLYSLAAMGARVEQWFEKILHR

SEQ ID NO: 8745 - protein, 351 aa, Methylorubrum sp.
MRIALLAHLRHPIAPPFAGGLEAYTWHLADGLTARGHEVALFAAGDSDPRFSIDPVIPVHHERSFPGLEHRGDSGLKAHVDAGYAAACDRIATGGFDVLHNNSLSRLPLERHRTAAVPTVTSLHVPPYDALRWWVHDSVAPGHRITVTSQAQARAWWPDGPPPEVSVLHNGIDPASWPFQADGDGSAVWCGRIAPIKGTHLAVRAARKAGLPVTLFGPIEEPEYWETQVAPLIGGPIRYGGHLGSPALAREIGRASVFLFTPCWDEPFGLVAVEAMACGLPVAGFARGAAAEVVGEAGCLVPPEDDAALSRAIGTALTIPRTVPRARVHRLFTRDRWLDRCESLYAAARAG

SEQ ID NO: 8746 - protein, 350 aa, Nonomuraea zeae
MRVALLGPVAWRTPPHHYGPWEQVTSLLAEGLTARGIDVTLFATLDSVTSGSLDGVCPRGYADDPSLDGRVWEAMHVAHALSRSGEFDLVHSHLDWLPLAFAGHCRAPLLTTVHGFSGTGILPAYARARSAYVSISDADRAPELDYTATVHHGIDLDAFPFDPVGGRRLIAFGRVHPDKGTHTAIEIARRAGLPLTICGIVQDERYFEREVAPKIDGEQVRFLGPVGPERRGEILGSGAALLHPIAFDEPFGLSVVESMACGTPVVAYRRGSMAEVVDQGVTGFLVDSLDEAVTAVSRISTVDRAGCRAQAERRFSADQMVANYLRIYHEMVGQNSRLIVSDGRADHAIG

SEQ ID NO: 8747 - protein, 361 aa, Halomicronema excentricum
MDAAPKYRILLISTAVAPLGTGLGGGVELFVKNAVQGLQQRGHRVTVVAPAGSQLENCDRLVPVEGQLQPTAHTSDRQTPIVMPKSSVLSAMMAYAQQVQSDYDVLLHFCYDWLPFYLAPFLQIPIAHYVSMGSLTDAMDAVIAQVTTQFPGTVGVCTQAQAATLPHAETYRPIGSAVDLALYDFCAEPGAALGWMGRISPEKGLEDAIAAAQATQTPLKILGKLEDQAYWEHLQKNYPEAPIQYLGFLDTHGLQAAIRDCRALLMTPKWVEAFGNVAIEAMACGVPVIAYRRGGPTEIVRPGKTGWLVEPDSVVGLVDAIAQIAQLDRSACRQQAEAEYSLDALAQRYEHWFHDILTRYA

SEQ ID NO: 8748 - protein, 360 aa, Paraburkholderia caballeronis
MRIAQIAPLYERVPPLAYGATERIVHYLTEALVASGHDVTLFASGDSVTSARLVACCESALWRDERVEDTLGHHVHLLERVAQRAAEFDVLHFHCEPLHLPLARRLDTHCVTTMHGLLREPDVGALLRAFSDAPLVSISASQRRAMPFANWRATIHHGLPADAFGLCMSPGDYLLWMGRMMRGKRPDLAIEIARRAGLPLKMAAAVHPGERAYFADEIAPLIESSAGFVEYLGEVGGDARTELLRHARALLFPIDWDEPFGMVMIEAFACGTPVVAFRRGAVPEVVEDGVSGFVVDDLDGAVRAVERIDELDRRRCRAAFDARFTAERMARDYLRVYRALARGAERDTDLQSSRPQPAAR

SEQ ID NO: 8749 - protein, 370 aa, Sphingomonas sp.
MRIAIIAHLKYAIREPFAGGLEMHTHLLATALRRRGHAVTVFASMKSDPAMGLEAICDETSLLETGTAEAQDVTFFREHHAYLRLMSMLRNRRFDVIHNNSLHYLPVSMAETLDTPMVTTLHTPPFCWLESGIRLCKSPSMRFVAVSDTIRGLWSHVTPIDRTIPNGIDLASFPFQPAASPDRYLVWYGRIVAEKGLHLAIDAARLAGYPLRIAGPISDPDYYAAEILPRLGADVTHVGHLEHAALGALVGGASAFLCTPRWEEPFGLVVAEALASGTPVAAFARGAIPALLDESCGTLARADDVASLADAARRAVLLDRRACRLRAEAICDADVMIDRYEDLYEEMIQPTRHAARGRASDYPITLAGAA

SEQ ID NO: 8750 - protein, 346 aa, Unknown
  Description of Unknown: Deltaproteobacteria bacterium sequence
MKIAQISSVYLSIPPKTHGGTERIVFDLCQHLTKRGHKVELFASGDSQVDCSLQSVLPVASSDDPQSTFYLEKEFEARNTYNLYRQAERFDLIHAHWPTLAPYFSSFSQTPTVITYAYIEKQLHEYYRTHFPRCFPVCISRTQARMLGDDSLPVIYNGIEVGEIPFNSQPEDFFIAVGRMTPGKGIAEAIRIAKRANARLLIVGQITSHLPWSEKYFSNEIQPHIDGDRIRHIERLPHDELMKTVGRAKGFLFSPQWEEPFGLAVAEAMAAGTPVLAYPRGSMPELVKHGESGYLLRTEDEMVEAIHRIESLDRRRCREWVEENFSVEQMVNGYERLYRQIAGSAR

SEQ ID NO: 8751 - protein, 336 aa, Micromonospora kangleipakensis
MKVALLGPVAWRTPPRHYGPWEQVTGLLADGLAARGVQVTLFATLDSITSATLDGVCPRGYAEDQSMDGRVWEALHVSHALARSAEFDLVHSHLDWLPLAFAEHCHAPLLTTVHGFSGAGILPAYEKGRSSYVSISDADRISGLEYLATVHHGVDLDGLPFTLDPGPGLVAFGRIHPDKGTHAAIEIARRAGRPLTICGIVQDERYFSEQIAPHIDGERVTFHGAVGPRRRGEILGGSTALLHPIAFDEPFGLSVVESMACGTPVVAYGRGSMPEVVDEGVTGLLVQTVEQAVEAVGRVASIDRAGCRARARQRFGADRMITDYLAVYDGIGRPER

SEQ ID NO: 8752 - protein, 364 aa, Unknown
  Description of Unknown: Rhizobiaceae bacterium LC148 sequence
MKIAQIAPLAERVPPKLYGGTERIVSYLTEELVAQGHDVTLFASGDSVTNAKLVRCSDVALRLNPAVKDHLPHHVVLLEEIRRRAHEFDVLHFHIDLLHFPLIREFADRTVTTLHGRLDLPDLHPFYQTFPDIPVVSISNDQRRPMPPVNWRGTVYHGLPDDVLSFTEKPEGHYLAFLGRISPEKRPDRAIEIASRAGMPLKIAAKVDNADKAYWETVIEPMVKSYPNVEFVGEINEHQKASFLGNAGALLFPIDWPEPFGLVMIEAMACGTPVIAFRCGSVPEVIDNGQSGILVDSIIEASENVEWALRLDRRKVRATFERRFTAERMASDYLDIYRQLPGTRTRAARLRRSSGHAVDLQVVA

SEQ ID NO: 8753 - protein, 370 aa, Synechococcus sp.
MASVPRDLVLVSTPIGYLGSGRGGGVELTLASLTQGLQARGHRLTLVAPEGSSLPAGCDGVALHTVAGGDQPSWQHADADGPVLIPPDAVLPRLWERALALGEEADAVLNFSYDWLPLWLTPRVQPRIFHLISMGSVARVMDQLVADLACWDQRRLAFHTHRQAADFSLPAVAQVVGNGFDLSRYQFQPEAGGALGWAGRVAPEKGLEDAAAVAAALQEPLQVWGVVEDPAYAARVERAVPPGTIVWRGFLPTAELQKELGRCRALINTPKWNEAYGNVVVEALACGVPVVAYDRGGPGELLQNGVTGWLVPPDDRDALLAATRKVDAIDRQACRRWVEAHASQAVFAERVEQWLDLTLAAGDGSISRCP

SEQ ID NO: 8754 - protein, 384 aa, Sphingobium xenophagum
MRIGIIAHLKHPIAEPFAGGLEMHTHLLARSLRDRGHAVTLFASSRSQPGINLEAICAETAIQTVGTTEASDVPFFREHHAYLSLMTDLRHRDFDIIHNNSLHYLPVAMADSLPMPMVTTLHTPPFCWLESGIRLCTARSHSFVAVSRSVAALWNHVTHSDAVIWNGIDLQKFAFHPQPAVDPYLVWYGRIVPEKGLHLAIEAARRVGLPLKIAGPILDDNYYRTEIAPALSQDVAHVGHLTHEQLAHLVGGARAFLCTPMWDEPYGLVVAEALACGVPVAAFARGAIPEILDSKCGVLAVPEDVTSLANAVLAALALDRSACRTRAEQMCDADRMVDNYEALYLRQIARAAPTVCSEKTASIHLMPSTRLPHSASSASSAFLG

SEQ ID NO: 8755 - protein, 404 aa, Unknown
  Description of Unknown: ANME-2 cluster archaeon sequence
SKTAGKLHTIGAKPYEEDKELDPKVWECLHISELFEHADEFDIIHNHYDFLPLSYSGLVQTPVVTTIHGFSSKKILPVYQKYNGKVFYVSISDADRSPHLDYVATVHHGIDIDGFPFNENPDDYLLFLGRIHPDKGVREAIEIARAAGMRLRMAGYIQDQHYFETEVKPFIDNDQVTYEGHVSNDVKNWLLSNAVALLHPIHFEEPFGLTVVESMACGTPIIANKKGSMPELIQEGENGYLVTDIKEAVIALKKIPNISRRRCREIAKELFSVERMVDDYIRIYDLILSKCKREDHRPWGYYETISESSDSKVKRINVYSGKRLSLQRHKQRNEHWYVIKGIGLVRLNDREFQLQSGDSIDIQKGASHRITNPGQDNLVFIEVQTGEYFGEDDIERLEDDFGHE

SEQ ID NO: 8756 - protein, 348 aa, Kribbella sp.
MKILQISSCWARTPPDGFGPAEEVTYDLSVELAAAGHEVTVFATGDSTVGLPLAFHFPEVPEYSPANPRKHVEAAVEYANSHDFDIVHNNESKHGALLAHTIRRPTITRANWLYDADFLQQFHALDEKARRATRFVAISHRMRTLLPELSFAGTVHNGIDVDGFPFGADKQDYVLFLGRIIPEKGVDLAIEAARTAGVPLVIAGQLLDRHRKFFEQKVAPALDGDQVSWYGPASRTQAKQLLRDARALLMPYRWEEPFGKVLVEAQACGTPVVSVPWGAVPEVVADGITGFLRATAEEMAAAIGQVDRISPTACRERAVTRFSRGRMAADYVHLYEKLLVDAGRGSRR

SEQ ID NO: 8757 - protein, 366 aa, Unknown
  Description of Unknown: Alphaproteobacteria bacterium sequence
MHIAQVAPLTEAVPPKLYGGTERVVHWLTEELVALGHDVTLFASGDSRTSGTLEPMWPKALRLDGSIRDPNALHMMMLERVRQRAAEFDFLHFHLDYYPFSLFSRQPTPFVTTLHGRLDLPEHQPVFTTFASIPVISISNAQRRPVSQARWVRTVHHGLPENLLRPRPVKPSYLAFLGRIAPEKCVDRAIRIAARCEIPLKIAAKVDRVDVDYFETEIRPLLSLPFVEYIGEISDREKSEFLSGAIGLIMPIDWPEPFGLVMIEAFACGTPVVAFNRGSVSEIIEDGLTGFVVEDETSAIGAVNRLSQLSRERVRKRFEERFTARRMAKDYLAVYRSLMEERAPRPKLVAVQGLHPEGAASAQPRG

SEQ ID NO: 8758 - protein, 368 aa, Unknown
  Description of Unknown: Gordonia sequence
MRDTLRIAIVASSRYPIAQPFAGGLEAHVWHLTRALTLAGHEVTLFAGAGSDLPVDSDRLRGELFEPSAAARSDVSMPQLEALQDHHAYLSLMLSFTNNPGDYDVIHNHSLHYLPVAMGPAVETPMVTTLHTPPTPWLESALTLAPGTRCVAVSRHTAQSWSHVLGEIPVVHNGVQLDRWPAGPGGDDLVWFGRFVPEKGAHLAIEAAQRAGRRLRLAGPISDTRYFEQQIAPSLGGLVHYEGHLHQHDLARLVGSSGVTLVTPVWDEPYGLVVAESLACGTPVACFARGGIPEIVGEHAGVLVPPGDIDALALAVDDALTLDRGLVRRRAEDHCTDIAMIDRYLDIYADLVAGRPLADSSLPREVGV

SEQ ID NO: 8759 - protein, 1017 aa, Onthophagus taurus
MLFKIFLIINVHFVLAENILFVNLVPSPSHHIWNEALIEGLLSKNHNVTMIGFYPANIISNNYSILQINDEKFTENISSTLKNVIDETSVKSILSMWEFIQKSCEFNMNSEEFKALLNYPKSFFNLLIFDITFSECYLPLIDHFNNQPAIGVTAFGLQTYLNDIIGESIQIYTPYYGLPYTDKMNLFQRFCSIFYTTIERLSRFYYLPKLDEINKKVFGENVRKINELGNEISLIFPNDDPILDYPKPNVPNVIQIGGVHLKEINQSATKIDEDLEKILNNSVEGIVFVSLGSNFQPKFYKDHVKSAFIEAFSKLNQTILWKFDDIVTSKNVIIKNWFPQSDILAHSNTKLFITHCGALSSQETIFRGIPIIGIPLFHDQYYRSAKFEEIEAGIILNYKEITANKLYESINEVLMNSRYKENMMKLSSLYKNQPLKPLDKFLMWFDYLLKNGDLRNLSVAGRKMSWYQTNNYDILGLIVVIVVVVKMLVNKLVFNGGDKKEKTDRTTLIMLKFFLVLISIQQITCKHILFINLVLSPSHHGWNEVLIEGLLSKNHNVTMIGYYEPKIKHPNYNVLQVDVKPFAQNVDAIYEQASADGSASIKSIFNLATFAENGCKYSLNTQQFKQLLDYPKDSFDLIIFDITLSECFLPLIDHFGLPPTVAVTAFGMNTYYNDIVGQSTENYIPYFGLPYTDQMSFFERMHNLFYLTMESIIRVNSIKKLNVISKESFGTKSRSIEDLFKEISLIFPNDNPILDYPRPTAPNVIPIGGVQVKPPKKLDKDLQKILDDSKQGVIFVSLGSNFLPKFYGKHVIKAFKESFSKLNQTVLWKFDDDGDLSKNIITRKWFPQSDILAHPNTKLFITHCGGLSTQETIIRGVPVIGIPLFADQFNRAGKYQSINGGVILKYSELTTDKVYNSIVEVLSNPVYKNNMKRCSMLYNEQPEKPMEKFLIWTDYILNNGHLKHLSLARREMRWYQVDNWDIFGFIIGVCLFLYVLLKKISCVILKMCKTDRKEKIN

SEQ ID NO: 8760 - protein, 512 aa, Biomphalaria glabrata
MSNKMFYPALLAVLVVSPYLCGAKHVVMMPAPTKSYLIYHAKVGHALTELGHTVSICVPDYLANKGFVPNKAISIIKYGKQLGDIEAYIFNKTNIIAGFWAGEVPGIGNLGILINTFKEVVNQILSEEAFITSIRDLKPDFLILESFVFTRNLIVLPYKLDIPFGLIGPSQDSLLNRVPFNSASETFFFENGSDRKTFLERVKAVVASAILMAYDPFTDADIVTRYAPDKPYTTIREIALKAEISIAETDHILDYPQSTLPNTKRVGGFSVSDAKPLPQDIKSFVERSSRGVAVVSFGGGDIKVPDHIKSKMATAFQKLDLNIVWKTNGGSEKEDNILALNWIPQNDLLGHPKTKVFISHCGTNGQYEALYHGVPILCLPIFGDQFYNANRIYVKGFGLHADIRDITAEKLTQLIQQVADDSKYRTNTQKASQIFKELHKIPSKEAAYWFDHVMKYGGDYMRSSGQQIPLYQFLLIDVIAFLLAVVIVFTLVVCLILRMCCRRLKKSKLKTA

SEQ ID NO: 8761 - protein, 512 aa, Diuraphis noxia
  MOD_RES (473)..(473): Any amino acid
MSFIKAKKNKMKSIVFAYAAVVFCALTIAQTRSSEILVIFPTTAQSHYRVVQPLIHRLLDRGHKILAITNFPDAVERANLSHINISRLKPHSKFNANNNGIIKSITRVIGNVYSYATILNHPTVAKLLKSGRKFDLVIAEFFTSTPIFAPIATVVDAPIVGFCPMIKFPWMNEVMGMETTVSYMPSVFSNFTDHMSFVQRVSNTVKLAIIGVSFNWIYTPIIREIIKNHYGIQTESTIKSMANLSLIMTNDYHSMFLPFPKPPGIVEVGGIHVVDEKPVPQDLNDFINDADHGVVLFSLGSVVSEASLGADKLRHILDAFSKLKQRVIMKFDAEKNKTIQLPVNVKMVKWLPQRDLLAHPKVLLFISHAGIMSVIETIHCGKPMVSIPIFGDQVFNTKLLIDKQVAVTIEYKHLESDGLLNAINEVLTEKYTINMKKLQQLYNDRPHSPLDTAVYWTEYVIRNKNESKELLKXQMVHLNLYQSKLLDIFAAFLLPLIAVYIIQRIMKRLRKQ

SEQ ID NO: 8762 - protein, 209 aa, Capitella teleta
GSLGSNLPSRVNKRLMAAFSRVPQRVVWAFPHDAPEETPANVLVLRWIPQNDLLGHNNTKLFITHCGANGQFEALYNAVPMIAMPLFGDQPYNALRAEYNGIGLQMNILEFTPDDLTKAIDRVIHGDYGRQIQRLSDIFRSRPLTPVQRSAYWIEHILEYGGDHLKSYALEMPWYEYLMLDILLFVLGIALIAVTLLACCLKSLCCGKK

SEQ ID NO: 8763 - protein, 366 aa, Asbolus verrucosus
NIPSPSHHIWNRALAFGLANKGHNITYIGPDEDELPKPQNYTHILLEGVYEGMNHNFDINEMSTYGPLAMIMEFENWCILQCQLNLKSKGFRKLLIYPPNFKFDLIVIDITAGTCLYPLIQRFNYPPTVGVTPFLLPTVWNFLYTHIDIGLRYFNQYAEEHELAKKIFGENTPSMQELERHISLVLANTDPVLDYPQPVPPNIIPVGGLHTRKSKQIPHDLQTVLDNAKNGVIIFSLGTNVRSDKLGKEMQTEILDAFSKIRETVIWKFESKIENLPKNVIVRKWLPQNDILGHPNVKLFIGHGGALSTQETIFHGVPMIAIPFIVDQHINTKLIVKKQIGVHVEFRHITSNYLLNKIREVLDNSV

SEQ ID NO: 8764 - protein, 484 aa, Otolemur garnettii
MAGQRVLLLVGFFYPGILLSEAAKILTVSTMGGSHYLLMDRVSQILQDHGHNVTMLNKRGNSLMSGIFENLLKVKEQLGFQCSHLLSRRDIMDSLENENFELVIIESFDYCPFLITEKLRKPFVSILTTSFAILDFGLPSPLSYVPVYSSLLTDHMDFWGRVRNFVTFFTFSRRQWQVQSMFDNTIKEHFPEGSRPVLSHLLLKAELWFVNSDFAFDFARPLLPNTVYVGGLMAKPTKPVPQDLENFIAKFGDSGFVLVTMGSMVNIDNFKEVLKELNSAFAHLPQGVIWRCKHSHWPKDVNVAPNVKLMEWLPQSDLLAHPRIRLFVTHGGQNSIMEAIQHGVPLVGIPVFGDQSENMVRVEAKKIGVSVELKELKAETLALKMKQIIEDKRYKSAAVAASLIRRSHPQSPAQRLVGWIDHILQTGGAAHLKPRAFQQPWHERHLLDVLGFLLGLTLGTLWLCGKLLGAACRWLPRARKLKET

SEQ ID NO: 8765 - protein, 401 aa, Camelus ferus
MGEQRVLLLVGFLLPGLLLSEAAKILTVSLLDGSHYFLLERVSQILQDHGHNVTMLVNTGPILDPDLKKKGKSFQVISWFLSEDDVNELRKRFHFFVTEALHGREALVNLVRIIEHLGTRCSYLLRSDIMDSLKNENFDLMVVEAFDFCSFLIAEKLEKRFVSVLPTPFGSADIGLPSAVSYVPVHFSYLTSPLDFWGRVQNFLLSFHFSMRQWQMHSAFDKTIKEHFPEGSRPVLSHLLKKAELWFVNSDFAFEYARPLLPNTVYIGGLLAKPIKPVPQELENFITKFGDSGFVLVALGSMVNDCQPDEVLKEMNAAFACLPQGVIWNYKASHWPKDIKLAANVKLMDWLPQNDLLGHPRICLFVTHGGMNSVMEAIQHGVPMVGIPILEDQHENMLRVE

SEQ ID NO: 8766 - protein, 523 aa, Chrysochloris asiatica
MAAQRALLLLGFLLFRGLLSEAAKILTVSLVGGSHYLLMDQVSQILQTHGHNVTLFQQQGLSLISDFKEEKKPYQVIKWLPPETFKEEFTKRFDLLVEEALHGRGTFEHFLKFMEQLGIQCSHLLRRKDIIDSLKDENFELLVLESFDYCPFLIAEKLGKTFVSILPSSFGTVDIGLPSPISYIPVYGSLLTDRMDFWGRMKNLKNFLAFSMKQRQIHSQYDNTLREHFPEGSRPVLSHLLLKAELWFVNSDFAFDFARPLLPNTVYIGGLMVKPIKSVPQDLETFIAKFGDSGFILVALGSMVNTYQTHEILKEMNSAFAHLPQGVIWRYKHSHWPKDVQLAANVKIVDWLPQSDLLAHPKIRLFVNHGGQNSIMEAIQHGVPMVGIPLFGDQPENLLRVEAKNFGVTVLLKQLKAETLTLKMKQVIEDKRYKSAAMAASVIRSSHPLSPSQRLVGWIDHILQTGDGAHLKPYAFQQSWYEQYLLDVFLFLLGITLPFMWLCGRLLCMVARWLCGSRKLKQT

SEQ ID NO: 8767 - protein, 523 aa, Nannospalax galili
MAGRCALVLAYLFLSGTLLSEAAKILTISTVGGSHYLLMDRVSQILQDHGHNVTMFHQGVNTLISGFKEEEKSYKFIKWIPPEDFQKEFNKYFDFFLEEALARRGTFEKFLKSVELLGFQCSHLLHRKDILDSLRNENFDLLVVETFDYCPFLIAEKLEKPFVSLLPSLPASVDIGLPSPISYVPVFHSLLTDRMDFWGLVKNLLMFFYYSTKQKKILSQYDSTIREHFAEGFRPVLSDLLQKAELWFINSDFALDFARPLLPNTVYVGGILAKPVKPIPQDLENFIAKFGDFGFVLVALGSLVSRYQTQEDLKEMNNAFAHFPQGVIWNCKGSLWPKDIKLAANVKIVDWLPQNDLLAHPSIRLFVTHGGINSIMETIQHGVPMVGIPVFGDQPENMVNVEAKNIGVSLPLMKLKEDTLALAMKQVIEDKRYKSAAMAARVIRHSHPLTPAQRLVGWIDHILQTGGAAHLKPYAFQQPWHEQYLLDVILFLLGLTLATLWLCGKVLGLVTRWLSRDRKVKKT

SEQ ID NO: 8768 - protein, 281 aa, Citrus unshiu
MSSSVATAAEAEIWIVPFFGQDIYFHALNYASKSLLVITNLPSSFLLTFPPPASSLPLIDVMMGSAAVECAMWQARIQDVKPGEARLLPGLPVDMALFESDLKHRPHGPPPGGPPPLRGAPGSEKIGPPEAGDQPHWMKEVEGSMALMFNTCDGLEGPFINYLANQLGKPVWGVGLLLPEQFYKSGGSMLRDHEMRTNRRSSNMTEDEIVQWLNLKSCGSVLYVSFGTEVDPTLDEYLVLANVLEASNRPFIWVDWILYVIWTNQQKTVIFVVVWIIKSVL

SEQ ID NO: 8769 - protein, 477 aa, Drosophila simulans
MRLGCAWLAFGLLLHLNLYLELGQAANILGVFPYRIPSPFQMVRPLIRALVERGHKVTMVTPADYPAEIDGVRHIRVPMLNQLMQTLMDNDHFVDALGDKWREGVLASTIFYNVSHAILSDNGVQMLMRDKSSRFDMIMVEASHLDALYGLAEFYNATLLGISCMHMTWHIDYLAGNLAPSVYEPVSPIGFALDSSLLSRWSNWIYITEEKLLESLVYRPAQVRLFKKFFGYPAEKLDELRARFSVILVNSHFSMGRVRANVPNIIEVAGVHLSEPPEPCGEELQKYLDEAEHGAIYFSMGQDILMKYLPENMQKQLLLVFFQIKQRVIWKSELSMLPNKSENVYVMDKVPQRMVLAHPNLRLFITHGGLQSVMEAIDNGVPMLGLPLFFDQFNNIHRVQLAGMAKGSANESSGHCTLVDGVRSTESGYFPYASQCGGDSSNAILQTRQHTNLWSSPWLRLCIADLSGLEIVPEESQ

SEQ ID NO: 8770 - protein, 330 aa, Nematostella vectensis
MLAFGIDTIPAYVPQLMSGLTRYMGLPERIKNLGFYFGSRFLMEWFIYPTYKLIKEKHGISPEKTVKESLSTVDLIIMPRDFILDHAQPIPPFVKVVGFFLPSPPKPLPAELEAFMQRSGDEGVILLSFGSMIEGLHNDTMLMMLKAFSQMPQNVLVKLDLNGLPKDSVPPNVRAVKWLPQNDVLGHSKTKLFITHAGANGLAESAYHGVPMICVPIFGDQFDNSQLAKDIGIAEMIKVNDMTADQFVSTLQRVLTQGRFKESSARISKAMKRRLRAPVAEAADLVEYVQALGHVDHLKPRGFSMPIYQLYMLDVLAVLVVAFISIVAVV

SEQ ID NO: 8771 - protein, 519 aa, Pogonomyrmex barbatus
MRVVTLVSLSILLFCTFQRSQEYNILGICPSSSYSHQQAFRALMKGLAARGHNITVISTIPLKDPPPNYENVDLSSSYIYMNCTGLRHMGKYEFTRYNMLGATYVCKHQLYTPAINQLLAKNKTFDAIIIEQLWYQCYYALVKHYNFPVLIGFLSVGNLPYVMDSVGNPDDPNFNPDMTYPFTDRMTINERIKNILYTTWTRLYYRFWHLPRAQDLANEKMPGTSVYDIDKNFSLVILSNNHVFGYPKPLLPHVIEVHSLHILEKPDPLPKDIREFLDNAQDGAIYFSLGSNLQTDQLPAGTLTTLCNALGSLKQRVLWKHDGNMAIHPTNIKFVKWVSQQAVLAHPKVIAYVMQGGLQSLQEAVHYSVPLVAIPFFGDQHFNARKILDAGIGLTLDIDTITENSIVQTLTEIVENKTYLNNIQTMSAIVRDELVKPIDKAVWHVEHVLKFPNSKHLQYRGHDVSWIDYYMPYLLFYLSCVTIFRGFIYLLYKYVIRNMLYKIVKYFRKNKQTANLKRD

SEQ ID NO: 8772 - protein, 358 aa, Lottia gigantea
MIGSYIFPGSSGGPPQTHTFPFLLSPYTPNMTLPHRVLNTLMTMGFYAVMQVIKWSSPFSKDNLRNYVPTEVLDVDVRDAARKSLLFMENNMDIMDYPKALYPNHIRVGGLTTRPASPLPQDLENFFSKSKNGVIVVSFGSTLRKSPKQFFERVVNIFKHFKQSVVMSYSENAEYGNVKTMSWLPQNDVLAHKNTVLFVSHCGKNGLNEGFYHAVPIVCMPFHGDQAGNGVKVKYLKIGDSINMLNSKDEDIIQTVQNVLNDKSFKANMNRLSAIYHDAKFTPRETAANALEHVLKFGGDHLRPVSSDFNFLAENMTDVWFIIFMFLCLFIYLFYRLVKCCCCCLCVKQKAVVKNKKE

SEQ ID NO: 8773 - protein, 550 aa, Homo sapiens
MAGQRVLLLVGFLLPGVLLSEAAKILTISTVGGSHYLLMDRVSQILQDHGHNVTMLNHKRGPFMPGLSDSPASASRYPRILYLQKYCQFGLKDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 8774 - protein, 500 aa, Rhopalosiphum maidis
MKSISFAGVVFCALAISQQTWSSEILVIFPTTAQSHYRVIRPLIHSLLDRGHKILAITNFPDTVERANLSHIDITGLKPHSKFKTTGDYGIIKMISRISKNAHTYATILNHPPVVKLLQSGRKFDLVIAEFFTSTPIFAPIAAAVDAPIVGFCPMISFPWIHEVMGMETTMSYMPSLISASGNHMSFFQRISNTLNSVVIDIGFNWIYTRVIRDIIKHHYGIETESVIKSMANLSMIMTNNYHSVFLSYPTLPGIVEVGGIHVIDEKPVPQDLNDFINNADHGVILFSLGSIVSEESLGTDKLYNILDAFTKLKQRVIMKFDIEKRNIQLPVNVKVVKWFPQRDLLAHPKVLLFITHAGMMSVIETIHCGKPIVAIPIFGDQIFNSHLLVEKQVAVILEYKHLESDQLFNAINEALTEKYIINMKKLQQLYNDRPHSPLETAVYWTEYITRNKNESKELLKSQKIHLNLHQSYLIDVFTVLLLPLIIAIYITLWTMKRLR

SEQ ID NO: 8775 - protein, 523 aa, Cyphomyrmex costatus
MRIVTVVLLSISLFCTFQHSHGYNILGICPSASYSHQQSFQALMKALAFRGHKVTVLSTIPLKNAPPNYEDVDLSFSYIKKDCTGLRHVGAYAIFHQNLVEANLLCRHQLFSPAVDKLIASNKTFDAIIIEQLWYQCYYALVKHYNFPVLIGFLSVGNLPYVMDSVGNPDDPNFNPDMTYPFTDRMTINERIMNILYTTYTRLYYRYWHLLKAQRIANERTSGTSVYNIDKNFSLVILGNNHVFGYPKPLLPHVIEVHTCHTFQVSLNEIFINIIFQDVQEFLDNAQDGAIYFSLGSNLQTDQLPAGPLTALCNALGSLKQRVLWKHAGNMAIHATNIKFVKWVPQQAVLGHPKVVAYMMQGGLQSLQEAVHYAVPVVAIPFFGDQYFNARKILDAGIGLTLDIDTITENAIVQTLTEIVKNKTYLNNIKTMSAIVQDELMKPIDRAVWHVEHVLKFPNSRHLRYHGQDMSWIHYYATYLYLGTDFALLLYISYILYNKIVSPFVTYASNLKRWISNLKRKLD

SEQ ID NO: 8776 - protein, 514 aa, Trichechus manatus
  MOD_RES (200)..(200): Any amino acid
  MOD_RES (341)..(341): Any amino acid
MAAQQALFLFCLFLPGALLSEAAKILTASLMGGSHCLLMDQVSRILQDHGHNVTLFQQEGLSLLSGFLQGKKTYQVISWLPPEGFRKEFMKSFNFFVEEALHGRETFEQFLKLMELLGIQRSHLLRRRDIVDSLKNENFKLVVVGIFDYCPFLIAEKLGKSFVSILPSSFGTVDFGLPSPVSYIPTFHSLLTDRMDFWGXMKNLLMFFGFSRKQWQIHSRYDNTIKEHFPEGSSPLLSHLLRKAELQFVNSDFAFDFARPLLPNTVYVGVLMAKPIKPVLQDLESFIAKFGDSGFILVSVGSMLSTYQTQEIGKEMNSAFAHLPQGVIWRYECSHWPKDVXLAANVKIVDWFPQSDLLAHSSIRLLVTHGGQNSIMEAIQHGVPMVGISLFGDQPENLFRVEAKNLGVSIPINQLKAGTLALMMKQVIEDKRCKSAAMAASIIRRSHPLSPSQRLVGWIDHILQTGGGAHRKPSAFQQPWREWNLLDVFLFLLGITLGSIWLCGRLGHRVGPGS

SEQ ID NO: 8777 - protein, 480 aa, Trichoplax adhaerens
MTGRDIAKRKSSYLVVHVVFHFFPTLKILLGVNILILLSRYCWVLAFSSSLMNRYREKNKSVVTRYTTRKYPNSNLDSTANYLSPTFVNGVFDVSSFSAKKNNDVYLQPCHIHAGMDLATFSKERNLLENVKRQNCDGVLCDISSPICQIITEAANIKVLVAVAAFGFADPLVTGFCHIPNPLAYVPQLGLKFTNKMPLHQRIIKVVVSHLTSTLVHLFFLPYMFAEVNKTSLGIDSIPDLVYSRASFLLVNTDFTMDYPRPTSPTTKVTALKYATNVTMLFNTFSQLPYNVIWKYTEHIPQSIASNIKIIQWWSQKDLLGHSNTKALVTHCGLNNILEGAYHGVPMIGIPVVGDQASHGPKIAAKNVGVVLNVEETTQDDLYYAIINVTTRQDIIESTLRISKLIQNRPNSRTPVEEASDWMEYALNCNDGEYLRTEKYNISWHQFYLIDVFALVLVFLVIAVQLMRLIYVLYTSNIYV

SEQ ID NO: 8778 - protein, 512 aa, Nylanderia fulva
  MOD_RES (79)..(79): Any amino acid
MHVVTLVLLSVLLFHAFQYTHGYNILGICPSASYSHQQPFQALMKALAARGHRVTVASTIPLKNPPSNYENVDLSFSYXEKDCTGLRHMGAYTLLHKNMWEANELCREQLFSPAMDKLIAGNKTFDAIVIEQLWFQCYYALVKHYNFPVLMGFLSVGNLPYVMDSVGNPDDPNLNPDMAYPFTDKMTIVERIQNILYTTWTRLYYRYWHLPRAQYIANEWTPGVSVYDIDKNFSLVILGNNHVFGYPKPLLPHVIEVHSLQISEKSEPLPEDIREFLDNARDGAIYFSLGSNLQTHQLPAGPLTALCNALGSLKQRVLLKHDGYMAIHPTNVKFVKWAPQQAVLAHPKVMAYVMQGGLQSLQEAVHYSVPVVAIPFFGDQLFNARKILDAGIGLTLDIDTMTESFVVQTLREVVENKTYLDNIRTMSAIVQDELIKPMNKAVWNIEHVLKFSNLRHLRYHSHDMSWLDYYAPFLYLSGGLALSLYVSYILIMKNIGIFIKIRSTSYLKRKFD

SEQ ID NO: 8779 - protein, 221 aa, Homo sapiens [sequence omitted]

SEQ ID NO: 8780 - protein, 514 aa, Camponotus floridanus
MHVVTIVLLSILLFRAFQHIHGYNILGICPSASYSHQQPFQALMKALAARGHRITVASTIPLKNPPSNYENVDLSFSYRKKDCTGLRHMGAYTLLHKNMWEANELCREQLFSPAIDKLIAGNKTFDAIIIEQLWFQCYYVLVKHYNFPVLIGFLSVGNLPYVMDSVGNPDDPNLNPDMAYPFTNKMTIIERIQNILYTTWTRLYYRYWHLSRAQRIANEWTSGVSVYDIDKNFSLVILGNNHVFGYPKPLLPHVIEVHSLQISEKSEPLTEEIQEFLDNARDGAIYFSLGSNLQTHQLPAGPLTALCNALGSLKQRVLLKHDGYMAIHPTNVKFVKWAPQQAVLAHPRVMAYVMQGGLQSLQEAVHYSVPVVAIPFFGDQLFNARKILDAGIGLTLDIDTMTESTIVQTLREIVENKTYLNNIKTISAIVQDEAELIKPIERAVWNVEHVLKFPNSRHLRYHGRDMSWIDYYAIYLYLSGGFTLLFYIGYILNMKNISVFIKSRRINHLKPKFD

SEQ ID NO: 8781 - protein, 509 aa, Tribolium castaneum
MYKVFIFCLSVKCVLSANILYVSPIPSPSHHIWNRALALGLVNKGHSVTLIGPDKDKVHPKNYSHIYMEGIYEELDDSFDINEMGTYSPAQMMLEFESWSLFSCEKALKTQGLQKLLGYPADSFDLIIFDVTTGSCFYPLIQKFNYPPSIAVTAFLLPTYVAHNFGNHLYPSYIPWYGLQYTSEMSFVERVWNFIFTYADVVRRKISLYQKEHSMAKEIFGENIPSMEELERHISLVLANTDPILDFPQPVPPNIIPVGGLHTRKSKDLPQDILTVLDNAKHGIIVFSLGSNLRSDKLNKQTQNALLEAFSKIQETVIWKFESDIENLPKNVIVRKWLPQNDILGHPNVKLFIGHGGALSTQEALYHGVPMICVPFIVDQHINTRIIVNKNLGIHLDFKKITAGYVLQLLREVLDNPKYTENMKKISNIFRDRLETPLERGVFWVEYVLRHGGAQFLTTPARDFSYFKACSLDVIAFLFAIATVIVIIVCKMFALIMKACSSKKKIKVN

SEQ ID NO: 8782 - protein, 370 aa, Exaiptasia pallida
  MOD_RES (79)..(79): Any amino acid
  MOD_RES (333)..(333): Any amino acid
MLFADKALFGCGNLLKEKVGIPTIVDFSSWGFNDFNNWQNGISWHLSSIPADGIYNTREHGIPFLWRAANVLAYLLINXLGKAATRLVMGSLKSKHGIAPDKSFPQIISETDLVLMPIDWSIEWPRPVPPNVKVIGPTTPKQSKPLPEDLDTFMRSASKGIVLVSFGSMASSLDDTRSKILSEAFSMLQGYKVLWKYKKSFPDVKNLKIVSWVPQNDILGHSSLRLFMTHGGVNSVYEAAYHGVPMLITPLWGDQAGNAAKVKTAGFGESVNIRTGDNFTAEHIAVQMNRILDNPRYKTNAIKVSKLLQDRRQPSTEDAADWMEYVLKHNGTXHLRPNSTQLPFYQYFLLDVISFLLGVIFVLLFIVYKS

SEQ ID NO: 8783 - protein, 213 aa, Trichoplax adhaerens
MFAEVKKTSLGIDSIPDLVYSRALFLLVNTDFAMDYPRSITPTTKVVGPILPKPAQSLPSDLQQFASKNPNGTEIVSFGTVVTALKYVSNVAMLFNTFGRLPYNVIWKYTEDIPQSIASNIKIIQWLPQNDLLSHLNTKVLVTHCGLNSILEGAYHGVPMIGIPDVGDQASHGPKIAAKNVGIVLNVKGMTQDDLYYAIINVTTRQDILEKNS

SEQ ID NO: 8784 - protein, 516 aa, Tribolium castaneum
MKHFITFLVIFVGLLCKIQCAKILMVYQMPAHSHYSLGLRIAKELAERGHQVTIINPYPQKTPIKNFRDVSVEDHIEFIQAFKKSLFSRNSMSLFGNINFLIGLGAELTNRTLGHVNVQKLLRSGETFDLLIAEYFFNDAIIGLGHYFKIPVVLTAPNAVSGVNNNLFVNPTPASYVPHVLSPYNKHMNFWQRLHNWYIGLLSNLMKEFILMPRHCAIFKQHVSQDVELDETLGNVSLVFTNSHASVTDAVPHQPNMVEIGGYHVDPPKKLPGDLQQFLDGAKEGAILFSMGSNLKSRDLKPEVRSGILAAFSKIKQKVLWKFEVEFDDCPENVKIVNWVPQQDALAHPNIVAFISHGGLLSTIETVYHGVPIIGIPVFGDQPSNIAAAVANGYAVSIDLFELNEAKLSWALDEILNNPKYRENAKQRSKIMQDQPLKPIDAAIYWVEHVIRHQGAPHLRSAALDLAWYQREMMDIFAFLGLVAATLGVIICLIFKTMFERCCGKKRTIQSIKKNN

SEQ ID NO: 8785 - protein, 208 aa, Macaca fascicularis
MHSAFSHLPQGVIWKCQSSHWPKDVRLATNVKIVDWLPQSDLLAHPSIRLFVTHGGQNSVMEAIRHGVPMVGLPVNGDQHGNMVRVVAKNYGVSIQLNQVTADTLTLMLKQVIEDKRYKSAVAAASVILRSQPLSPAQRLVGWIDHILQTQGAAHLKPYAFQQPWHEQYLIDVFVFLLGLTLGTVWLCGKLLGVVVRWLRGARKVKKT

SEQ ID NO: 8786 - protein, 403 aa, Onthophagus taurus
MLFKIFLIINVHFVLAENILFVNLVPSPSHHIWNEALIEGVLKCYLPLIDHFNNQPAIGVTAFGLQTYLNDIIGESIQIYTPYYGLPYTDKMNLFQRFCSIFYTTIERLSRFYYLPKLDEINKKVFGENVRKINELGNEISLIFPNDDPILDYPKPNVPNVIQIGGVHLKEINQSATKIDENLEKILNNSVEGIVFVSLGSNFQPKFYKDHVKSAFIEAFSKLNLTVLWKFDDIVTSKNVIVKNWFPQSDILAHPNTKLFITHCGALSSQETIFRGIPIIGIPLFHDQYYRSAKFEEIEAGIILNYKEITANKLYESINEVLMNSRYKENMMKLSSLYKNQPLKPLDKFLMWFDYLLKNGDLRNLSVAGRKMSWYQTNNYDILGLIVVIVVVVKMLVNKLVFN

SEQ ID NO: 8787 - protein, 301 aa, Biomphalaria glabrata
MAYDPFTDADIVTRYAPDKPYTTIREIALKAEISIAETDHILDYPQSTLPNTKRVGGFSVSDAKPLPQDIKSFVESSSRGVAVVSFGGGDIKVPDHIKSKMATAFQKLDLNIVWKTNWSSEKEDNILALNWIPQNDLLGHPKTKVFISHCGTNGQYEALYHGVPILCLPIFGDQFYNANRIYVKGFGLYADIRVITAEKLTQLIQQVADDSKYRTNIQKASQIFKELHKVPSKEAAYWFDHVMKYGGDYMRSSGQQIPLYQFLLIDVIAFLLAVVIVFTLVVCLILRVCCRRLKKSKLKTA

SEQ ID NO: 8788 - protein, 523 aa, Bos mutus
MAGQQALLLFGFILPGLLFSEAAKILTVSLVGGSHFLLMHQISQILQDHGHNVTMLLQKGNLLLPGFKEEEKSYKVFNWFLPEDCNEEFKRSFHSFMEKNFGGRCKFEHFLNIMKLLGHHCSHLLRRKDVMKSLKNENFDLVIVEMFDYCPFLVAEKLGKPFVAILPSALGTVDFGLPSPLSYVPVFYSLLTDQMDFWGRVKNFLMFFEFFKKQWKIQSAYDDTIKEHFPDDSRPVLSHLLTKAELWFVNTDFAFDFARPLLPNTVCIGGLMSKPVKPVPQEFENFITKFGDSGFVLVSLGSMVSFIRSQEVLKEMNAAFAHLPQGVIWKYNPSHWPKDIKLAPNVKIVHWLPQNDLLGHPRIRLFVSHGGMNSIMEAIQHGVPMVGIPLFGNQHENLLRVKAKKFGVSIQLKQIKAETLALKMKQVIEDKRYKSAAEAASIIRRSQPLTPAQRLVGWIDHILQTGGAAHLKPHAFQQPWYEQYLLDVFLFLLVVTLGTMWLCGKLLGLVARWLCGARKLKKA

SEQ ID NO: 8789 - protein, 395 aa, Trichoplax adhaerens
YELIISDARAFSNDKKLLDELKNENFDAIVCDVSCYMCQVVAEYIDIKIQVDVSLFGFGDPLLARAFNIPSPLAYVRQVGLTSPYKMGLYHRTFNVILRLIVPFFIDQFMFNPMYAAINTTNLGLDSLPNYSIKRSTFLLVNSDFALENSRPITPTTKVVGPILPRPPAALPPNLQQFINSNNKGTIVVSFGSVFSALKFLTDIQIFFHSFDRLPYNVIWKYPDENRVNMDNSIKTVQWLPQNDLLGHPNVIAFVTHCGLNSVLEAAYHGVPMVAIPVAGDGYDHAQKILAKNIGVVLDVKTITSDEVFNAIMQVTTDKSIIASVKRVAKCIKNRPNNRTPVEEAVDWIEYALGNEGGHYLRTMEYTIPWYKLYLIDIFTIFFIALFIILKIFQF

SEQ ID NO: 8790 - protein, 468 aa, Saimiri boliviensis
MLLSSEKHLAADTKDKEKSYQVIRWFPEDYRKRIKERFNNYIEKALDGRKEYEGLVKLMEIFGTQCSYLLSRKDIMDSLNNENFDLVFVEGFDFCSFLIAEKLEKPFVAILPTSFGSLEFGLPSPLSYVPVFHSLLTDHMDFWGRVKNVLMFFSFCMIQRRIHSTFDNTIKEHFTEGSRPVLSHLLQKAELWFVNSDFAFDFARPLLPNTVYVGGLMEKPIKPVPQDLENFIANFGDAGFVLVAFGSTLDIYESQEVLKNMHAAFAHLPQGVIWKCQSSHWPKDVHLATNVKIMDWLPQSDLLAHPSIRLFVTHGGQNSIMEAIRHGVPMVGLPVNGDQHGNMVRVVAKNYGVVMQLNQVTADTLALKMKQVIEDKRYKSAVVAGSVILHSQPLSAKQRLVGWIDHILQTGGAAHLKPYAFQQPWHEQYLIDVFVFLLGLTLGIVWLCWKLLGMVARWLYGVRKVKMT

SEQ ID NO: 8791 - protein, 523 aa, Orycteropus afer
MTVQNALLLLCLLLRGALLSEAAKILTVSLVGGSHYLLMDQVSQILQDHGHNVTLFQQEGLSLIPDLKEEKKTYQVIHWLPPEDYRKEFMKHFNSFVEEVLHGRETFEKFLKLMEKFGIQCSHLLRRRDIMDSLKNENFELLIIETFDYCPYLIAEKLGKPLVSFLPGTFGTVDFGLPSPVSYVPAFNSLLTDRMDFWGRMKNLLMFFDFFRKQWQIRSQYDNTIKEHFPEGSRPVLSHLVRKTELWFVNSDFAFDFARPLLPNTVYVGGLMARPIKPVPQDLETFIAKFGDFGFILVALGSMLNTYQFQEILKEMNSAFAHLPQGVIWRYKCSQWPKDVQLAANVKIADWLPQSDLLAHPSIRLFVTHGGQNSIMEAIQHGVPMVGIPLFGDQPENLLRVEAKNLGITIQLKQLKAETFVLKMKQVIEDKRYKSAAMAASVIRRSHPVSPSQRLVGWINHILQTGGGAHLKPYAFQQPWYEQYLLDVFLFLLVATLGSIWFCGRLLRMVARCLCGSRKLKQT

SEQ ID NO: 8792 - protein, 542 aa, Vicugna pacos
MGEQRVLLLVGFLLPGLLLSEAAKILTVSLLDGSHYFLLEQVSQILQDHGHNVTMLVNTGPILDPDLKKKGKSFQVISWFLSEDDVNELRKHFEFFVTEALHGREALVNLVRIMEHLGTRCSYLLRSDIMDSLKNENFDLMVVEAFDFCSFLIAEKLEKHFVSVLPTPFGSADIGLPSAVSHVPVHFSYLTSPLDFWGRVQNFLLSFHFSMRQWQMHSAFDKTIKEHFPEGSRPVLSHLLKKAELWFVNSDFAFEYARPLLPNTVYIGGLLAKPIKPVPQELENFITKFGDSGFVLVALGSMVNDCQPDEVLKEMNAAFARLPQGVIWNYKTSHWPKDIKLAANVKLMDWLPQNDLLGHPRIRLFVTHGGMNSVMEAIQHGVPMVGIPILEDHCAPAPCLDGLQMLSLQKYQQHKSASATWTRAQTPASSLGMGPDLSPASTWGQPVADCAHSELPEAELPWPGASQKETAMAGSHPCHCQCTLTVGLFMVDPGSPAHTPSFSPYLTPAPSGCLRAPTPVLSPWVCPLKPSFGTQSLHAPAG

SEQ ID NO: 8793 - protein, 486 aa, Erinaceus europaeus
MAKKWASLLFLLQLYCCFSCGSSGKVLVWPMEYSHWINLKTILDELTERGHEVTVLTSSASILVDPSKQSAVKFEVFTTSFTKDKLDSIFMTLIKMWTYELPKSSLWAYGSRMQETYYEYSDTVQKLCEDAVSNKKLMKKLQEIGFDVVLGDAIAPCSELLSAILNIPLVYTLRYTTGNTYEKLCGKLPLPPSYVPVVISELSDKMTFMERVTNMLYFLYFDFAFETFNKKKWDRFFTEVLGRPTTLCELMGKADIWLIRTYWDFEFPHPYLPNFEYVGGLQCKPAKPLPKVIWRFDGKKPATLGPNTRLFKWIPQNDLLGHPKTKVFVTHGGGNGIYEAIYHGVPMVGLPMFVDQPDNIAHMEVKGTAVRLDLNTMTNTDFLNALKTVINDPSYKENAMKLSRIHHDQPVKPLDRAVFWIEFVMRHKGAKHLRPAAHDLTWVQYHSLDVIGFLLACVAATVYIITASCLFCFRKCTKSGKRKKND

SEQ ID NO: 8794 - protein, 489 aa, Saimiri boliviensis
MAGQCVLLLVGFLLPGVLLSEAAKILTISTVDFKKEEKSYQVISWLAPEDHLREFKKSFNFFLEETLCGREKFENLLNILDYLALQCSHFLRRRDIMDSLRNENFDMVVVETFDYCPFLIAEKLEKPFVAILPTSFSSLEFGLPSPLSYVPVFHSFLTDHMDFWGRVKNVLMFFSFCRRQWHKQSTFDNTIKEHFTEGSRPVLSHLLLKAELWFVNSDFAFDFARPLLPNTVYVGGLMEKPIKPVPQDLESFIAKFGDSGFVLVTLGSMVNTCQNREIFEEMNNAFAHVPQGVIWKCQCSHLPEDVHLAANVKIVDWLPQSDLLAHPSIRLFVTHGGQNSIMEAILHGVPMVGIPVFGDQPENMIRVEAKKFGVSIPLKKLKAETLALKMKQIMEDKRYKSAAVAASVILRSHPLSPAQRLVGWIDHVLQTGGAAHLKPYVFQQPWHEQYLLDVFVFLLGLTLGTLWLCRGLLRMAVWWLRGARKVKET

SEQ ID NO: 8795 - protein, 475 aa, Aethina tumida
MLKFIVLLAVCLSCVQCAKILAVFQMPSYSHQVVFQPIWKELSLRGHQVTVVTPLPLKDPTLKNLTEIDVSYLKVLGQKYNFLRTVSIDAWPHEKTKIMYQANYEFAEQVFENEQFKKIYQDPNAKFDLIIIQAYIGPIFHALGERFNAPVVGVNSMNAYIGQHFAIGNPHHPALYTDMYTEYQGELTFLERWYNTFFYLWARYFIHFEGMPKSDAIARKYLGNDIPYLGESVQKLSFLFTTTNPILYAPRPQVPTHVEIGRLHLKPPQPLPKDVKEYLDGAKEGVVYVSLGSNVLSSIVPDKFRNTLISALGKLPYKVLWKYEEDNLKDLPKNVVTKKWLQQQDVLAHPNVKAFVMQCGLQSLEETFSKNVPMICIPFISDQLMHIKRLVKYEASIGIDHKNTTDEEIKNAVLEIINNKKYKENVKKINDLWNDEPIKPLDKVMFWMEYVIRHNGTAHLRSPYADVPWYQFLVS

SEQ ID NO: 8796 - protein, 532 aa, Drosophila yakuba
MFPSGRWLVPIFWLISNWICWIRGSRILVIAPFDTYSQCMLVTPYIQALQDRGHQLTVIHAFKHCMPQIENVTFIRIWNNNNTYAEFEESMVIASASNKWEEISTISKVMANVTLNVLTNVEVRALMQSGITFDVVVLEAGYSDVLYGMAAHFNATLIGICTCVADWNINNLVGYTTSTLTEPIVPFGVKSMKNVWDRIYNWFYTSEEWLLMNLVFLPTQRLVHDHFFGHLEKSFLEIRQDFALMLLNQHFSLFRSRPNVPGMVEVAGLHIPKEDPQLPSDLQVFIDEAEHGVILFSLGLEQHINDLPMKTQVILVETFKSIPQRVIWKFDGESTVPLDSSIYHSSLLPQQAILAHPNVKLFITHCGIMSVIEAAYYATPVLGLPSFYDQFINLEVMKEEEAALELNINSLTVQELKDTVESLINQPKYRENALAISQRFRDQLMHPMDTAIYWTEYIIRYKGANHMKVSRSQLKLFEYYFLDNFIMVGMRLFLVVAIVFVVLSKSRRWLNHLSTKSFLPYAGIQNNKKAIS

SEQ ID NO: 8797 - protein, 485 aa, Ceratotherium simum
MDRVSQILQDHGHNVTLLLQRANLLISGFKEEEKSYQVITWLPPEDYNKEFMKFFDFFMEETLAGRDTFESFLKLMELLGLQCSHLLRRSDIMDSLKNENFDLVIVESFDFCPFLVAEKLGKPYVAVLPSSFGGVDFGPPRPLSYVPMLHSFLTDRMDFWGRLKNFLMFFGFSMKQWQIHSMFDNTIKEHFPEGSRPILSHLLKKAELWFVNSDFAFDFARPLLPNTVYVGGLTAKPVKAVPQEFENFIAKFGDSGFVLVSLGSMVSSSSSQEVLKEMNSAFAHLPQGVIWKCKPSLWPKDIKLAANVKIVDWLPQSDLLAHPHIRLFVTHGGINSIMETIQHGVPMVGIPIFGDQPENLFRVEAKKFGVSIQLKQIKAETLALKMKQVIEDKRYKSAAVAASIIRRSHPLTPAQRLVGWIDHILQTGGAVHLKPHAFQQPWHEQYLLDVFLFLLVVTVGTLWLCGKLLGMVARWLCGARKLKKA

SEQ ID NO: 8798 - protein, 530 aa, Nothobranchius furzeri
MSLHQVSGIFVLFSLSLVFFPQHCDGGNILVFPVDGSHWINMKILLEELHSRGHNISVIRASTSWYIPETSPLYTSITIDMDVGLESFFDKHIQDYMKAQRKGASMLTFLKLTKDFCSMIVDGHSLWRDAVIQLFENQNLVKSLKDSRYDLVLADPAMGPGVVLAKYLNLPLVLNVRWITSGEGHFVLAPSPLSYIPVPGSGLTDNMSFFQRVKNMLFYGLVLFQEKFLLQPIYDAMCDKYIERGCNIVSLLQEADIWLFRSDFVFDFPRPTMPNAVYIGGFQCKPAQPLPADLEDFVQSAGEHGVIIMSLGTLVKTLPREVVEEIATVFAKVPQKVIWKHNGERPSTLGNNTLIVDWMPQKDLLGHPQIKVFVAHGGTNGVQEAIYHGVPVLGIPLFFDQYDNLLRLQERGAAKIIHLADVNGDTFEEGIKEVLYKDSYRQNMHRLSRLHKDQPLAPMDKAVFWVEYVMHHKGAAHLRTEAYKMPWYSYYCLDIILFLITAMIVLILSVCAMVKRVCCKRKNKKKIKQK

SEQ ID NO: 8799 - protein, 522 aa, Dictyocaulus viviparus
MPFIVEFLLISLCSSSYALNILVWSSTMGQSHNNFLGNIADILEADGHNVTLLMVEFDPDFKNSTGTRLVKHVMRYTSPYYDPADWRTLTFKQGRVFNVKVGLNLVDFINIQIFAYRICKGIINDPTLIQTLHESRFDIGIYEMFHYCPAGVMELAGIPKTMLVSSMGIGYHHYRILGMEKQSSFVPASLTNSGSRMNFFDRLSNVITNGLSWVFANICEHFEQALFRNKFPEFPSLLNLIRERTDYFLMNTNEFTESTRPTLRSIHYIGGSAIANPIPLSDVYEKIVSKSIKGVILFSLGSLVKSSQMPVAVRQAFIDAFRSFMDYVIIWKDDELKNTTIANIHFYSWIPQVDLLADGRVKLFITHGGMNSIQEALLFGVPMITLPLFGDQDSNAAVAAERGFSITLNKLALTREIIIDAINTILGRGGGESVYTQRVRQAARLLKGSPQEMRQTIKKLARVSATEPLLSHLKLDIHHLNDLQYYNIDVYLSIFTIFSFITLSYWSFKQLVLCLFVSPKYD

SEQ ID NO: 8800 - protein, 523 aa, Ursus maritimus
MVGQRTLRLAAFLLSGFLLSEAAQILTISSLGGSHSLLMDQVSHLLQDHGHNVTMLLTGEQSLIPDIPQNDISYNVINWLSPEGHRKEFKEYFDFFMREALRGRETFDNFVKLMEQLGIRCNDLLRRGDIMGSLKNENFDLVFVDIYDFCSFLVTEKLGKQFVSILPTQFGSMDHGLPSPVSYVPVSRSLLTDHMDFWGRVKNFLMFFDFYMKQRQLQSTIDNTIKEHFPEGSRLVLSHLLKKAELWFINSDFALEFARPLLPNTVYVGGLLARPVKPVPPEFENFIAKFGDSGFVLVALGSMVNKYQSQEVLREMNSAFAHLSQGVIWKYNPSHWPKDIKLATNVKIVDWLPQNDLLAHPRIRLFVTHGGLNSIMEAIQHGVPMVGTPVFLEQVENLIRVEAKKFGVSIQLKQMKAETLALKMKEVIEDKRYKSAAVAASIIRRSHPLTPAQRLVGWIDHILQTGGAAHLKPRALQQPWHEQYLLDVVLFLLVVTLGTLWLCGKLLGMVARWVCGARKLKKA

SEQ ID NO: 8801 - protein, 537 aa, Caenorhabditis remanei
MKNTISFVFLLCVGLVSPFNYLVFCPLYAHSHHKFLAKIADTLSDAGHNVTFLAPIIIRKYENVKYLDSTKDIVYIQPSKKLESLGVTSDYSKFWNQDATAIQFVPAIRAFTKMFEQLYEDLKEDLTVLDELKNRKFDALVFEFLCPTALRELTFKNSNLKLLVSAIAEYLDIKAVLPSLSMTHHPLMSRLIGEPSSPSVLPSMISSFGDDMTFPERLQNTIGDIFFTLFVHFPPMTSFKNPEKLIDVEDMTARSPFMFMNGNPYLDYPRPLLTKSVLIGGISVNVTQLKQEKLSENYNQILSKNKKNVLISFGSMIFSKDMPQEYKDTIVRVIESRQDVTFIWKYEEEDVSFAKNLPNLYFSKWVPQTALLADSRISAFVTHAGLGSVTELSYMGKPAVLIPIFADQLRNSKTLARHNGSITLSKYDLSDFDKLRNAIDTILNEESFKINAERLSQQLQDQPVSPQDLLVRHAEFAAKYGELPNLDPCSRQMSFISFYMIDIILFFGVIIGSVVLGVVLITRWAFSFCVRPKQKVQ

SEQ ID NO: 8802 - protein, 511 aa, Tupaia chinensis
MAGQRTLLFLGFLLPAVQFSETAKILTLVTVGGSHYLLMDRVSQILQDHGHNVSMLLRRGNSLISDFKEGQKSYEVISWFPPEDNQKEFNKCFDFFMEEALNGRARFEHLIKFLEQFASQCSQLLKRRDIMDSLKNQDFDMVIVETFDYCPYLVAEKLGKPFVSVLPSSFNAVTFGLPSPVSYVPVFYSLLTDHMDFWGRVKNLLMFFKFSMRQRKIHSVFDNVIEEHFAAGSRPVMFHLLLKSELWFVNSDFALEFARPLLPNTIYVGGLMTKPVKPIPQDLEKFITRFGDSGFVLVALGSMVSTYETHKVLKEMNGAFARLPQGVIWRCGRSHWPKDIELAANVKVVEWLPQNDLLAHSSIRLFVTHGGQNSIMEAIQHGVPMVGIPLFGDQPENMVRVEARKLGVSLQLKELKADTLALKMKQVIEDKRRSHPVSPSQKLVGWIDHILQTGGAAHLKPYAFQQPWHEQYLLDVFLFLLGLTLVAGWLCGKLLAMAARWLSGPRKLKET

SEQ ID NO: 8803 - protein, 528 aa, Equus przewalskii
MVPFLGGGTGSQQGTSMMRPRVLLLICFLLPGLLPSEAAKILTVSLVGGSHHLLMDRVSQILQDHGHNVTVLLQEGNVLIAGFKEEEKSYQIVTWFPPEDDFKEFLKFCEFFMEEALAGRDKFENFLKFMELLGLQCSHLLKRNDIMDSLKNENFDLLFVEGFDLCSLLVAEKLGKPFVSIISTSFGFIDFGLPSPLSYVPVFDSLLSDRMDFWDRVRNFLKFFDFSMKKWQIHSTFDNTIKEHFPEGSRPVLSHLLKKAELSLVNSDFAFDFARPLLPNTVYVGGLMAKPVKAVPPEFENFIAKFGDSGFILVALGSVVNIFQSQYVFKEMNRAFAHLPQGVIWKCNPSHWPEDIKLAENVKIVDWLPQSDLLAHPRIRLFVTHGGINSIMEAIQHGVPMVGIPFFGDQPENLFRVEAKNFGVSIQVKQIKAETLALKMKQVIEDKRYKSAAVAASIIRRSHPLTPAQRLVGWTNHILQTGGAAHLKPHAFQQPWYEQYLLDVFLFLLVLTVGTMWLCGKLLGMVAR

SEQ ID NO: 8804 - protein, 528 aa, Oryzias latipes
MYRVCGGLACFSLCLIFLVPSCSGGNILVYPVDGSHWINMKILLEELHARGHNITVIRVSTSWYIKEKSPIYSSITLEMEEALEDFFDVFVKEQIKVQREGASMLSFFKLNKDFLSMLTQAHVLWCDVTKDIFENEDLAKQITDSKYDVVLTDPAIGGGLVLAKYFNLPVVLNVRWIPVGEGHFVLAPSPLSYIPVPGSGLTDRMDFIQRLKNIFFNCITKFQELFLVGPIYDDICSKYIEGGCSIVSLLQQADIWLFRSDFVFDFPRPTMPNVVYIGGFQCKPAEPLPADLEKFVQSSGEHGVIIMTLGTLVNALPQDVANEIAEVFSKMPQKVIWKHKGDRPSTLGNNTLIVDWMPQKDLLGHPQVKVFVAHGGTNGVQEAIYHGVPVLGIPLFFDQYDNLLRLQERGAGKILQLADLNGRNFEEGLKEVLHNSSYRQNIQRLSRLHKDKPMSPMDQAIFWIEYVIRHKGARHLISEAYKMPWYSYHSLDVVLLLLAVGAVLLYSIYGVFRFLCCRRKIKTKTKLN

SEQ ID NO: 8805 - protein, 530 aa, Orycteropus afer
  MOD_RES (361)..(361): Any amino acid
MAAQRVLLLFCFLLPGPLLSEAAKILTASLLGGSHYLLMHQVSWILQDHGHNVTLLRTEVISLIPVLWGRQTVKCRIHIDLKIRTIINIHGTLFKTNKAIPWGNKTVIHKKANFDNILQFMGQLGIQCSHLLRRRDIMDSLKNENFDLLIVESFDCYTFLIAEKLEKPFVSFLPASFGFQDLRLPSPMSYVPVVYSLLTDRMDFWGQMKNLLMFFDFSRKQWQMYSQYDSTIKEHFPEGSRPVFSHLVQKAELWFVNSDFAFEFAQPLLPSTVYVGGLMAKPVKPIPQDLESFIAKFGESDFIFVSLGFMLNFYKNQELLKEMNNAFAHLPQGVIWKYKCSHWPKDVQLAANVKIVDWLPXSDLLAHPSIHLFVTHGGQNSIMEAIQHGVPMVGIPLFGDQPENLVRVEAKNFGVAIQLKQLKEETFALKMKQVIENKRYKSAAMAASVIRRSYPLNPSQWLVGWIDHILQTCGGAHLKPYAFQQLWYEQYLLDVFLFLLMVTLGSIWLCGRLLCMVARCLCGSRKVKQM

SEQ ID NO: 8806 - protein, 410 aa, Bison bison
MELLGHHCSHLLRRKDVMKSLKSENFDLVIVEMFDYCPFLVAEKLGKPFVAILPSALGTVDFGLPSPLSYVPVFYSLLTDQMDFWGRVKNFLMFFEFFKKQWKIQSAYDDTIKEHFPDDSRPVLSHLLTKAELWFVNTDFAFDFARPLLPNTVCIGGLMSKPVKPVPQEFENFITKFGDSGFVLVSLGSMVSFIRSQEVLKEMNAAFAHLPQGVIWKYNPSHWPKDIKLAPNMKIVHWLPLNDLLGHPCIRLFVSHGGMNSIMEAIQHGVPMVGIPLFGDQHENLLRVKAKKFGVSIQLKQIKAETLALKMKQVIEDKRYKSAAEAASIIRRSQPLTPAQRLVGWIDHILQTGGAAHLKPHAFQQPWYEQYLLDVFLFLLVVTLGTMWLCGKLLGLVARWLCGARKLKKA

SEQ ID NO: 8807 - protein, 219 aa, Diuraphis noxia
  MOD_RES (192)..(192): Any amino acid
MSSVPSNILSAFKEAFAELPQRVLLKYEGEMKDKPKNVMTRKWFPQRDVLLHKNVKLFVSHGGISGLYEAVDAGIPVLGFPLFGDQYRNIDNLVEAGMAISMELYSITKDNFLKNVLDLVDNKKYINNAKIASEIFKDRPMSPEKSVVYWTEYIIRHKGAPHLKSQALNLTWYQYFLLDIITVLLMFIFISXLIVLKLLKCIRTIFTNICSSFSKIKCD

SEQ ID NO: 8808 - protein, 429 aa, Plutella xylostella
MTLKLLILFLGAANSANILCVFPTPSYSHHTVFKKYVATLSESGHNVTVITPFEYNDCHNCLVPSYMFQKLTTSVVVADETTVTKTNYMSLINLITQQMKSENVTSLLNNKDTKFDLVVAEAYLEMLLMFSHFYQAPVIQMSSGHALPENFETMGAVSRNAVKHPNLWRSSHNIDYENKLQREWKLIEHAQDNVARKQFNSRPLKILRENVKLLLVNVPTIMDNYRSVPQTVQYLGGLHLNSTTIEPLDDELKRFADKGKFIYVSFGATKDLRNFDILSKMSRTFSNCKYNVLWKSRSYFNISENIMTRDWLPQRSVLKHGNLKLFITQGGVQSIDEAIDNTVPMLVVPTMGDQFFNAKRIVDLGIGKKGDLFNTGLMGRQINKIIDNYDLFKDNLKIVKRLINDKPMSSTHASLWYTNYVLRNKDLKR

SEQ ID NO: 8809 - protein, 520 aa, Miniopterus natalensis
MTGQALLLLPLLHWLQLLEGAKILTLSLYGGSHYLLMDRASQILQDHGHNVTFLQHNEFHVVSGFKKEKTYQSVLWTPPGDYHQEFKKNLEFCIKEAFLGRRPVMNLLKLVKLHATQCSHLLRRTDIMGPLKNESFDLVVVDGTDSCTFLIAEKLARPFVSILGTTFGVTSFGLPEPVSYVPAFYSSLTDHMDFWGRMTNLLMFFISTLRDWYTLAQFDGTIREHFPEGARPELFHLQRKAELWFVNSDFAFDFAQPLLPNTVYIGGLLDKPVEQIPQEFENFIAQFGDKGFIIVALGSLVNIVQYPEVLKEMNSAFAQLPQGVIWKCSPSLWPKDIKLAANVKIVDWLPQSDLLAHPSIRLFVTHGGLNSVMESIQHGVPMVGIPLFADQPGNIIRVEAKNLGVSILTEELKADTLALKMKQVIREKRYKSAVLAASIIKRSHPLTPAQRLVGWIDHILQTGGAAHLKPHAFQQPWYEQYLLDVFLFLLVVTLGTMWLCGKLLGLVVRRLCGARKLKKA

SEQ ID NO: 8810 - protein, 408 aa, Homo sapiens
MDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQYKNDDKAVLKKSLGMDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 8811 - protein, 323 aa, Callithrix jacchus
MEIFGTQCSYLLSRKDIMDSLNNENVDLVFVEGFDFCSFLIAEKLEKPFVAILPASFGSLEFGLPSPLSYVPVFYSLLTDRMDFWGRVKNVFMFFRFSTMQRCLHSTFDNTIKEHFTEGSRPVLSHLLRKAELWFVNSDFAFDFARPLLPNTVYVGGLMEKPIKPVPQDLENFIANFGDAGFVLVAFGSTLDIYESQEVLKNMHSAFAQLPQGVIWKCQSSRWPKDVHLATNVKIMDWLPQSDLLAHPSIRLFVTHGGQNSIMEAIRHGVPMVGLPVNGDQHGNMVRVVAKNYGVVMQLNQVTADTLALKMKQVIEDKRYVAL

SEQ ID NO: 8812 - protein, 523 aa, Equus przewalskii
MARPQALLLICSLLPGLLLSEAGKILTLSLVGGSHHLLMDRVSQILQDHGHNVTVLLQRANLLLAGFKEEEKSYQAITWLPPEDYNKEFKKYFDFFLKEALAGRDTFENFLKYMELQGLQCSHLLKRNDIMDSLENENFDLLFVDAFGLCSPLVAEKLGKPFVSVLPTTFGYMDFGLPSPLSYVPVFNSLLSDRMGFWGRVKNFLMFFDFSVKQWQTHSTFDNIIKEHFPEGSRPVLSHLLKKAELWFVNTDFAFDFAQPLLPNTVYVGGLMAKPVKAVPQEFENFIAKFGDSGFVLVALGSLISNYSSHELLKEMNSAFAHLPQGVIWRCKPSHWPKDISLAANVKIVDWLPQSDLLAHPRIRLFVTHGGLNSIMEAIQHGVPMVGIPLFGDQPENLFRIEAKKFGVSIQVKQIKAETLALKMKQVIEDKRYKSTAVAASIIRRSHPLTPSQRLVGWTNHILQTGGAAHLKPYSFQQSWYQQYLLDVFLFLLVVTLGTMWLCGKLLGMVARWLCGARKLKKA

SEQ ID NO: 8813 - protein, 525 aa, Physeter catodon
  MOD_RES (197)..(197): Any amino acid
  MOD_RES (200)..(200): Any amino acid
  MOD_RES (397)..(397): Any amino acid
  MOD_RES (401)..(401): Any amino acid
  MOD_RES (480)..(480): Any amino acid
MAGQHVLLLVGFLLPGLLLSEAAKILTLSLVGGSHSLLMNRVSQILQDHGCNVTLLLQRGNLLLPGFKEEEKSYKVINWFLPEDYNKEFKKSFHFFMEETFEGRSTFEHILAILEQLGLQCSHLLRRNDTMNSLKNENFDLVIVEIFNYCPFLVAEKLGKPFVSILPSSFGSVDFGPPSPLSYVPVFYSLLTDHMDXWGXVKNFLMFFDFSVKQWQIHSMYDNTIKEHFPEGSRPVLSHLLKKAELWFVNSDFAFEFALPPLPNTVYVGGLMAKPVKSVPQVKYENFITKFGDSGFVLVVLGSVVSIIQSQEILKEMKAAFARLPLGVIWKCKPSHWPRDIKLVANVKIVDWLPQNDLLGHPHVHLFVTHGGINSVMEAIQHGVSMVEIPLFGDQPXNLLXVEAKNFGVSIQLKQIKAETLALNMKQVIEDKRQKSAMVDTSIMKRSHPLTPSQQLVGWIDHILQTGGGAAHLKPHTFQXPWYEQYLLDIFSFLLVVTLGTSWLCGQLLGLVAGWLCGTRKLKKP

SEQ ID NO: 8814 - protein, 514 aa, Trichoplax adhaerens
MVVGLWLVMNAIACVQLSSAAKIAIGASFYHSHTQVLAAIGEELHKRGHSVTVITSTANHFVAGRGYNILFYETPVTQHDIGSCTAVALKKNDVFITTCMKHLIDDNKAYMNDDSLLQQIRAEKFDAIVCDIACYPCHVVSEAAEIPIQIDVSTLGFVDPFVSIPFHIPAPLAYLPRMGLVATNKMNLYQRTINVVISPLIMTFLDNFIFDSLYKVVNKSKLGLQAVPKFIDTRATFLIVNGDFAIDYPRPLTPTSKMVGPVLPKPPKSLPPHLEEFITSNPNGTIVVSFGTVVTAVKYVIDIQVLFMAFSLLPYNVIWKYTEEVPKQLLTSNIKIVKWLPQNDLLGHANVKAFVTHCGLNSILEGAYHGKPMLGMPVVGDQIAHAQKIIAKGVGVVLDIKSATVKEIHNSIVKITTDKQILDNAAQVSKLIKNRPNGRTPVEEAGDWVEFALNCDGGNYLRTEEYNLSWYQLYLLDVYAVIAIMLFIFVKLLNLVWMGFAWLCCRKGNKLKES

SEQ ID NO: 8815 - protein, 520 aa, Octodon degus
MARQELLLLVCFFLPQILVSEGAKILTVSQLGASHYILMDKVSSILQDHGHQVTKLLNKEATIPDLKEEEKPYKVIDWVLPEKNRNEILKHIHSLVEVLDGRDVFDVILKLWEHMGTSCSYLLHRDDIMNSLRNESFDLVFLDATDLCAFLIAEKLEKPFVVLLSMFHYVDFGLPSPLSYVPVYGSFLTDQMDFWGRVRNFLMSFVFYVKQWQMHSTFDNVIKEHFPEGSRPVFSHLLQKAELWFINCDFGFDFARPLLPNTVYIGGLLEKPIKPIPQDLENFINKFNDTGFILVALGSFISRFQTQTVLKEMNKAFANLSQGVIWKCDHSLWPKDIKLAQNVKMVNWLPQNDLLAHPSIRLFVTHCGMNSIMETIQHGVPIVGIPVFFDQPDNMVRVEAKKFGVSLQYNMLTAETLILKIKEVIEDKRYKSAAVAASIIHWSQPLTPTQRLVGWIDHILQTGGAAHLKPYAFQQPWYEQYLLDVFLFLLGLILCTLWLCRRLLGIVTWWLSGSRKLKKT

SEQ ID NO: 8816 - protein, 391 aa, Bactrocera dorsalis
MISLKSIAAALWILACVTNYVESAKILAVFPFPGPSQYICVQSYLKTLAARGHEVTSVSAFPQKTPLKNFRDITIHIDQSHHDEAVINAIEQIAVGKLAELQFAKEYTSLTSLLVFNNEDFQQLLHSDEQFDLIIIEVFYLDALYALGKHFNAPTIGVSSYGADIVIDELVDNVSPLAYVPAPSGMNMDRMNFWQRLDNLYANTMELLYTHLEIIPEQQRYYEKYFPNATLRLADVRRDFSLLLLNQHYSFSWPRPLVPNAIEVAGMHIENKPKKLPTDMEAFINASSRGAIYFSFGSNVKSASLPKQKLQEIMNVFASLPVNVLWKFEKTDLAGIPKNVFINKWFPQSDVLAHPKVKLFVTHGGMHSLIEAVHHAKPIVGTPFPWLLVCD

SEQ ID NO: 8817 - protein, 524 aa, Diachasma alloeum
MGFKIFGSIISIFLISCAIESASHRILAIFPFQSRSHQMMFDALIKGLVDRGHQMDVMTVYPMKKPLKNYTVVVNLEGKQESLVNQWNVKFASELGDDTLPIIALPFGNGLCEYLGLPEMQAIIKNPPQDPPYDLVIVESFGANCFIGLGHVLNVPVIMASSTVPLPWLETSLGQVQYPAFVPAFFTSHKHPMSFFDRVLNTVKTYSNNIRYRYYTEAVQNAQMRKYIDSDIPPLRELEKNVVLALVNSWHSLNPIQPVTPGVIGVAGLHVDANYVPLPKEMEKWMNDSTSGVIYFTLGSMVNIETFPDETMRAIYSVFRGIAPVRVLMKVANKTALLPGLPDNVMTSSWIPQVAVLAHKNTKMFITHGGLMGTQEALTYGVPLIGIPLFGDQHNNIVDYHSLGMAIELDIHNLSEESISWAVNEILHNPKYREAAKHQSMRFLDRPMSAMDTAVYWVEYAIRHGRGALRSPVVDLSWWQVALLDVYGFLSLSILLAIYLIFRIAKASLTAVTSTKNGKRVKSD

SEQ ID NO: 8818 - protein, 536 aa, Caenorhabditis elegans
MNFQYYIIFILFSIIDYSNSYKVLVFNPAFGASHSNFLGKISDILIDAGHDVTMLIPIAMQGKKHLVGSKKVKNIIRIDQDPRSIELYKQTGAEDVLRKKIWKVESDIALFFKMAGNFSKTCGYQCQHVFQQTEILEKLKNEHFELGITESLFICGYPLFDHLGVKTIINADSVLFMDIVKCTLGEPSSSTFYPALISPMTDKMTLVERIKNAIQMLIPVYFSKMRFEEELSMIEPYYNGSKTWEELLENVAFNMVNSNRYLDYASPTLPKTVFIGGMQVKTKKQGTPKLNKEWDDLLNIRKENVLVSFGSNAFSSEMPDEFKKSFLDVFASMPEITFIWKYEQENSTIAMHLSNVKMTTWMPQSDLLADNRLSLFVTHGGLGSSIELAYQGTPAVVIPLMADQPRNAHMLTRHGGAIQLDKTNLDNPQMIRDAIKTILDNDSYTENARKLAQILEDQPYTPAEVVLKHCDFAVKFGVLDTLQSEGRKLNVFQFYSYDILVVVCFLIITVVVFIVLYVFQCIKICSTIFSKKVKNE

SEQ ID NO: 8819 - protein, 457 aa, Aedes albopictus
MVSPYPLQSPLENYRHITIPMPDWSKGAMKNLMRDQSQWSMVKTFPEMNRIALESANNSIHHPEVHKIIKEEKFDLLVVGLMADFLLGVSNWIGAPTVVVNPNAAMPLVNEMVGNPYPIAAVPNTMRGMLNPMGFTGRMQNLLISFLEDAFNWYMKHTSEQFYDSIFPRGQFPSYDEVRRNVSLVLINQHFTKTSPRPYVQAMVEVGGLQIKQTPDPLPEDLRKWTDEAEDGFILFSLGTNLLSSTIPKEKLDALINTFARLKQRVIWKWDVEHMPNKPANILLKKWLPQDDLLAHKNCRLFVMHGGLGGVAEALFHGVPLLGMPFFGDQQANTLAVEKEGWAVIVQFADLTEETFSSAMDEVLINSSYTEKAKQLSSLYRDRPQSAMDTAVFWTEYVMRHKGAPHMRYPGVDLNFFQLHMLDLFAVIFVTLYIAIKVISLACSRICRRKPSKLKVR

SEQ ID NO: 8820 - protein, 532 aa, Lingula anatina
MLSVIATLILIVPQFIDGHTIGAIIYPGKGQFVKAQNLLKELKARGNEVYIIVGDNVEIEDLHDPEINLLQFKSRETHGYFEAADWQRGHTLSVLSQSPGVKQTGIFDMVNTFSNLTEHLFNYTEDMLKDEALYRHLEDVLTMDLMLMYGYPFWPSAYVFPYRHGIPYVTLTTTQLHLYAGVPVSIMPSYVPNQGFKWSSKMNFFERVFNFCLQTILPAIVLPDIPKQFCEEHVRNKQPRTFKEFLRGSELWLLTGNNFVMEDPLPSLPNVVFMGGMDTRPAKALPDDWDNFMNQAPYGVIIVSFGSISFQLTNEIYKKFYMAFRGIPYRVVWKYKGDLPLRDVPNDIRLEEWIPQNDLLGHWNTKLFIGHGGNEGQYECMYHGIPMINFPVYGDEIHNAERVQSKGFGLTMDIATFTPEELIDNIDEMMSNDSYRAAIKTASAIFRDFPLTPQQTAAYWIEHVTKFGSSHLHSVAEYLPWYQYFMLDVIGFLFAVAFIVCFVISNFVFYYYYKYCARRTLYMPLSPDKKNN

SEQ ID NO: 8821 - protein, 530 aa, Stomoxys calcitrans
MANKSVWLYLAFLGLSFQVLDAARILAFFSPVSYSNMLTYSAVTEALAQAGHNLTIFSNYANPNSYTTNKYPDHYQYIHLEGQALYDGRRLVNNTKGHYMVWFKVIDERLECAHSTLNHPKMLNFLAEHQAGDFDVVLVGHTMMDFLFGLGTHFQCPIISVTLLRPPYATNRLLGNPAEVSYYPRLTRVAWKAPLKFWQKVLNFVDYTVERYVLQPYINGINEEMYRYNFPPDRYPPLEEVYKNVSLVLTNHHFSQGPIRPNVPALLEIGGIQIKEQPDPLPEDLAKIMDSAKHGIIYFSLGTNVQGSNLSKEKAKMIFNVLSSLPQTVLMKWGDKDFPGEAANIIYKSWLPQDDILAHPNVKLFITHGGQGSVVESQYHGVPMVGIPFFGDQHSNMANVEKSGFGIGLKYATLNENELRASVLEVLNNPKYRENVQRFSKLYRDRPMSPRQLVSYWVDYVIRHKGAKHMQSPAVHMSWWELHSLDVIGFLVAVLTGVVWLLVFLVKLLCCRGRKASASKAVKNEKKKKA

SEQ ID NO: 8822 - protein, 428 aa, Unknown
  Description of Unknown: Mycobacterium tuberculosis H37Ra sequence
MEETSVAGDPGPDAGTSTAPNAAPEPVARRQRILFVGEAATLAHVVRPFVLARSLDPSRYEVHFACDPRFNKLLGPLPFPHHPIHTVPSEEVLLKIAQGRLFYNTRTLRKYIAADRKILNEIAPDVVVGDNRLSLSVSARLAGIPYIAIANAYWSPQARRRFPLPDVPWTRFFGVRPVSILYRLYRPLIFALYCLPLNWLRRKHGLSSLGWDLCRIFTDGDYTLYADVPELVPTYNLPANHRYLGPVLWSPDVKPPTWWHSLPTDRPIIYATLGSSGGKNLLQVVLNALADLPVTVIAATAGRNHLKNVPANAFVADYLPGEAAAARSAVVLCNGGSPTTQQALAAGVPVIGLPSNMDQHLNMEALERAGAGVLLRTERLNTEGVAAAVKQVLSGAEFRQAARRLAEAFGPDFAGFPQHIESALRLVC

SEQ ID NO: 8823 - protein, 477 aa, Diaporthe ampelina
MSPPLILYAIPPREGHMRPALQISSHLVSRGLDVTILGDARWSPAITAIGAHASPIIGLWGAMEDYTKWGDIIRAQTAEERLRVSLSDGFVRLLPSGLESVRHALAGIRDRLGGGGDALRGRTVVVLSDTCFSGTLPLKLGTDLPRGYEGVIVRTVGIGLVPRFWAAPERPPWGSGLPHDVTEDGISRNLEAHAAKWDQAAEDRARWLLGAMNCSKSVDELYEEYDKGSTAIKRPFWDASTVCHDVVLQMGLPSFEFPVPNEPAHLKFAGSLPPKPIPSDLVYPDWYSEVLQNSSSSAAKPGRKKIVFVAQGTEVLDHRDLLIPCVKGLAGREDILVVAVLCQKGATIDKHLSLFEGGRLPDNARVIDYFPYDAILPHADVFASNSGYGGLTHAVAQAVPVVQAGDVFDKPDIGRRVEYSGLGVFLANSPPTPEAVAAAVDEALGQDKYKKRALSLQAESRGYDPLEIIESEIRALP

SEQ ID NO: 8824 - protein, 205 aa, Plutella xylostella
MLPLQTKILSKWEDDTLTNIPKNVILRKWFPQIEVVAHPNVKLFIGHGGLISLLETINAGVPILGIPVFADQYLNIHSTIQNGNGAMLEHKNINEHNLRTILNKMLIEKRYKEKALEISTRFKDRPMNGLDTAIWWIEYVIRHKGADFIKTPALKFNFLQYYMLDVLLLVLAVALAPLLVVWKIVSLFKSKPVKKNVEKKKQKRN

SEQ ID NO: 8825 - protein, 500 aa, Drosophila guanche
MNRSPVRSILLLMLGICSTAQVESHHILGLFVNVHRSQLLVHMAVARALLQRGHQLTVVTTLPLAEVQLQGNVTHIVVPWEQPVDEVQPGSTSDWLLRLQRMFNRLEQSGDLLDQPAWKDFLKLSPKPHFDLLLLGYHFNDHLLGVAAHFNCPTVIVSTQQPIGFVNSLMGNPEERWYVPQPYDSRQRSGISAWLFGVWEKLMEMVARRVLQKIYSLHFPEPHYPPLETMRRSVVLALNNHHMISEGPIAPLLPSMIDMGGILLEQKLNETLPAIARNRSLIIFSLGTRFSWQRSPGHLVETFTEAFAQFPDYDIYWTYDGPNASEMMSYHSHLKLAKWWPQRHLLGQQQARLFITHGGKGSVTEALYYGVPMLGLPLLGDQRSNLQKMEAKGWGLTLSMQNVSHVELAKAMGRILSDSHYSASISTASHLYRDRPMSASDVATYWLEYVVRHRGAKHLYSPARQLNFVQYHSLDVYALVYGGLLLLIGIFSRINQWGFL

SEQ ID NO: 8826 - protein, 522 aa, Culex quinquefasciatus
MRLLVVFGVLLMGGFSQGSRILAVFPSTSKTNYIFGQVLFEELAARGHQITVISPFEVQYDSEHVTQIKLTGMFTHLEDYGMNTNIFTKWDRSSFYGNSHLIYGTAAMADYTLGHPKVQELLKSDETFDLLLLDQVLSDSLLGLAYHYQIPAIVYSSTAPNKFINEMVANPHNPAYNPISSLGYSDRMTFRERLWNTFVSICEQFNYKYLYLPSQEAVFQRHFARKYLPPLLDLIHNVSLVLVNSHPVITYPRPLVPSMVEIGGLHLRQFDETGLSQDVINWLEAAKNGAIYFSLGANTKSTDLPDNVRRAFTGAFGQLSGTLILMKWENATLENQSSNVIIGPWMPQQQLLAHPNVRLHITHGGLMSMMESVQYGKPILGIPLAGDQEILVDRAVSAGYGLKLDYQNISQEIVLESIKRIMEESSFRENALRVSRQFREQPMKPMDKAVYYIEAVAKDGGAGVDVLRSGALILTFWERHLVDVALCFVAIFLVPVVLVAALIQVILRKTHRGKVDAKKKTN

SEQ ID NO: 8827 - protein, 216 aa, Rhagoletis zephyria
MDSDPSTWAEWTELRRNWHQSTTFNDLIEEAGYPRYPNDSYPQNSILTVYACPEELNYGPLRALPWFNLEVFNPPKDEGLKPLTELGVPQSFLSDDIGGRFSGHLIYASLGSMGSVDLDLMERLISALSTSPHKYIISTGPRHEQLLGGKPLPANMWGGPFLPQTSIIPHVEIVITHGGNNSVTETFAAGKPMLCLPLFGDQFDNAQRLLETGYGR

SEQ ID NO: 8828 - protein, 517 aa, Caenorhabditis briggsae
MTQNLNILIVNPIFGFSHVKFLSTLADIIAERGHNVTVLQPFHIAMNNLDGLIKDKSVKIMNYYPDNFSELEKNEEQTFKMAWDSKLMQNPILGALFSGMVAKQFKNTVIKMLRDEKLHKELSSYNFDAVLVETFEISGFYLAESLQIPAIAVLSAVRYPVFDELFGQSSTLGYIPATGSSLPPKAGFFSRLNDVYNTFFLSIGQKAMNNAQYNVIKEAIGRKPTAWQDLVQRSPVYIVNANPYLNFAVARPGNVVQIGGITMLKKGTLKKIELPEEYEKILNERESSVFISFGSVVRAYEMPENFKKGILKMFELLPDVTFIFKYEDELEEDMNSRIPKNVYLKKWVPQPALLLDDRLKVFVTHGGLGSTMEVAHSGKPALMVPLFADQFENAQMLARHGGAVDYNKFDLANGKKMAKVLKEMISNPSYQKNAQELQKVLLNQPINPKENFIQHLEFACKFPTWQSQTPGISRSGFIPYYYLDVILFLIATPATLIGAFTYLMTRSFSYQLVESYT

SEQ ID NO: 8829 - protein, 510 aa, Aedes aegypti
MNSLFRIAFVFGTVLSLTSAYRILSINVSPSRSHIIVQEALVKELARRGHHVTMVSPYPLQTPLDNYRHITVSIPDWRKGTMKNLMQDQSPWAMVKTFPEMNRIALEAANNSIHHPEVQRIIKEEKFDLLMVGLLADFLLGVSNWIGAPTVVVNPNVAMAIVNEMVGNPSPLATVPNAMRGMTSPMNFIGRMKNLFITTMEYAFGWYMKHTSEQYYNSNFPRGKFPSYDEVRRNVSLVLINQHFSKTSPRPYVQSMVEVGGLQVKQTADPLPEDLQKWTDEAEDGFILFSLGTNLLSSSIPKDKLDALINTFARLKQRVIWKWDTEHMPNKPANIVLKKWLPQNDLLAHKNCRLFVMHGGLGGVAEALFHGVPLLGMPFFGDQQANTLAVEKEGWAVIVQFSDLTEATFSTAVNEILTNSSYTERAKQLSNLYRDRPQSAMDTAVFWTEYVIRHKGAQHMRYPGADLNFFQTQMLDVIAVIGVGLYVIIRVLCLTCKCICRRKQHKLKTK

SEQ ID NO: 8830 - protein, 592 aa, Anopheles darlingi
MRHLILLSLAFLAIVAFSDGYKILFLAPFPGPSHWLMMKHFISELAGRGHEVTCITAFQYGEPAPPNYTEVYIDPPYPIRKTFPVEALFAASQSSDFEKLYMYWDLGVNTSRHGLESDPVRQFIARRDLTFDLIIAEQFFQESWLMFAHQYDAPIVTISTYGYSDFFDRIMGLRTPLSFVPHMIFSYEDDMSTSERLHNLYISMYDAYYRQNYYLPKQNRIAQKAFADWASETGRKLPDIVNLEKSISVILVNSHPVLNRPRPTIRGLVDIGGAHIRPVQPLDPQLRVFIEGADEHGVIYFSLGAYMQSAVMPADKRQAILNVFGSLPQRVIWKFEDESLQKKAPPNVLIRKWAPQNDILAQPQVRLFISHGGQFGTFEAMKHGVPTLFFPFFADQQRNADRAILAGFAERMNFADITEQTFAYKIRRMLENDQYREKARHIATLFNDTLVDPMESAIYWIEYVARYRGAQHLKSHAVKLTWLQYHMYDMVIYPLLLSYIIYILYGQKLRRMRKYLPIVSAICVTLFFLYNMYDMIMYFVLLLCPLYNDYWPKFKRSRTYLHVVCVICALFYLQGYEPIEPIRKYLLLSKLS

SEQ ID NO: 8831 - protein, 497 aa, Drosophila mojavensis
MNCLLRYPLLLLAYWIAAGVHGSRILCLSVGVHRSQLLVHLAVARVLLQRGHQLTLVTSQPLERDWLTANVTHLLLPWQLPREQVIEPHANFLTRLQWTLERLEKSGELLDQPEWREFMEHTPSTPYDLLLLGYHFNDHLLGVAAHFNCPVAIITTQQPIGFVHSLMGNPEERWYVPQPYDSRQRTGLEGYIFGLWEKLSELLARRVMQRIYSTHFPSPQYPSFEEMRRRVILALNNHHMVSEGPIGPLLPNMLDIGGIVMEQMERKELNLPRRPFIVFSLGTRFSWLTMPGKVEKAFVDAFAQLRDYDIYWTYDGANASTIHLANSHVHLEDWWPQAQLLAHPLARLFITHGGKGSLSEALYYGVPMLGLPLLGDQRPNLRKMQNKGWGLSLDIHNVSQAELLCSIKRLLNEKQFRESIRRSSLLYRDRPLNASDLAAYWLEYVIRHKGAPHLSGNARHLNFWQRHLLDVRLAVYGPLGMLGWLALWLNRKLNCNR

SEQ ID NO: 8832 - protein, 1025 aa, Danaus plexippus
MKLQIIFSLVFLASFTQALRLLVFFPMMSKSHSILGQGMVSRLLEAGHEVVHVTAFPRDKPQANLTEINLIEASNRMKEQFQGDDNFKLKNLIGKENIGDSVFFVYMTYEISKNIIEDQTFIKFLLNPNEKFDAVIIEWFFSDIFAGIAPLFKCPLIWFGSTEAHWQILQVVDEIPNPSYSVDIFSVSKPPLNFMERLRELYRIAKKYIFISLLSTPFERSLYNSVFSDIANKRGVTLPSYDEVIYNASLLLINSHPSIGTPFRLPQNAKYIAGYHIDREVKPLPKDLQKLMDEAKHGVIYFSMGSNLKSEDMSESMKKSLLAMFSKLKQTVIWKFESDLDKVPANVHLVKWAPQQSILAHPNLKFFMTHGGQLSTTEAIHFAVPVIGIPVAADQHVNMRSVANKGFGIYIKITEDITDDLYPAIQEMLQNPSYKSKAKELSFIYHNRPLTPGDELVFWTEHVVHTRGALHLRSPALQLPFYQKFFLDLLILILVAIVLCVLMISKCTMYYTCLLLFIKLYLCHAYKVLVVFPIPWKSHYILGEATVWHLVKAGHEVTYLTPSPIENAPKGLRQIDISASSRFFPKGRFDIVSLINKKGRLMTQEQKIRTTHDYLVKSLELDNVQNFIKDSNEQYDVVVVEWLHTETMAGFASLFSCPLIWVSTMEAHTLVLSLIDEHLNPNYNVLFYSTNFSRTLWNRAKQLWSLTKILFYTWYRQNRENEDFKNIFGSAILKRGRELPYFRDVKYNASLMFGNSDVVTGDAISLPQNYIHIGGYHIKEPIEPSPSFDLKGLMDESSNGVIYFSLGSSLNITRIPRYLKKGILKSLGEVDQTVILKMDHIPEDQPKNVHTVPWAPQQYILAHPNCKLFITHGGQLSIIETLYFGIPIIGIPLFADQYNNVNRAVAKGFGKQIDFNSNTPEVLKNTIKEMMTNSSYRATAKHLSSLFIRSPTPGQRLVKSVELVARTGGAQHLRSVALNVPLYQKLYLDLILVFIIGVLGFLFVITYLYHFVTNIRRPKTLKKKD

SEQ ID NO: 8833 - protein, 524 aa, Diachasma alloeum
MKIGFFVSIIIIFVITFATRNEAYRILAIFPLQSRSHHMLFDALIEALAEKGHQMDVMTVYPLKKPLKNYKVVVNLERVAKHVVNQWSIEYASKLGDDVLPTLTTVYGNELCEYLALPEMQEIIKNPPQDPPYDLVILEAFMSNCFIGVGHALNVPVIMVSSPLPYPWLEISLGQPQFTAFVPSRNTNYQYPMSFFVRVLNTIRSHYDYMRFNYYTEAVQNAKMRKYIDPDIPPLRELEKNVALALVNTWHSLNGIQPLTPGIIEVAGLHMEANYVPLPKEMEKWMNDSASGVIYFTLGSLVNIETFPDATIRAFYSVFRGIAPVRVLMKVANKTALLPGLPDNVMTSSWIPQVAVLAHKNTKMFITHGGLMSTQEALIYGVPLVGIPFFGDQHSNIIDYHSLGMALELNNHNLSEKAISWAVNEVLHNSKYREAAKRQSFKFLDRPMSAKDTAVYWVEYAIRHGPDALRSPLVDMPWWQVALLDVYGFLSICILASVYLIIRLARALLRAVTPTTHGKRMKSD

SEQ ID NO: 8834 - protein, 533 aa, Caenorhabditis remanei
MLLLLIFSILFTPVSPLNILVYSPAYAGSHSNFLGKLADTLTERGHNVTYLMPVVMVGKRDECIGVKLTKDIVIVEAGEETLSQQKGDSTNDGNMKAYWEATMNSSNARAIGGWFNIAMKSACRHLHSQRDVFKQMKAKSFDVAILEPISVCGLGYVKALGIEKTILATSFTFFDFVLPHIGEPLDYSSVPGAFGASGEVMSMAERYENWLVTKEMNLGQEDMFEGEMKAYREFSGKDLPDWRELLPSASLFFVNSNPFLDFPRQVIQKTIPIGGITINLEWIKAQKLSADWVEILEKRPHSMLISFGSMIKSSHMPEQWRNGLLNAIKSMPNVTFIWKYESDDISFAEGVENLHFSKWVPQTALLNDPRLTAFVSHGGVGSTLELAYSGKPTIMIPIFADQIRNANMLARHHGIIHLNKRSMENFEVTRKAFHDILFDDSYKVNARKLAELLADQPYSPKDNVIKYTEFVGKHGPFPAMDPYGRHMNTFQKNFVDIYALFALFYVLCTALILAILRSIYLKFGSSKSSTKLE

SEQ ID NO: 8835 - protein, 507 aa, Capitella teleta
MRLLFLICCLIEGTTSVKILLMPVNHGSHARFFSLVGQTLQEEGHVVHVLLGDNFRHHSEERGLRVVSMGMDLKYVLEAVHEKLFDSSKWGMWQLLKAMKDKGSAYCEAALSQGVPYEVLEAEKYDLVLIDNIDPGRCMYVVPYRLNVPYISLGARHDPWSARVPALPSSEGQIIVSTLSANSTFRERLLNTVASLAFWVLFPPSFAVDPSYLKRFAPNRPETTFDQIYQDSEMWIINMDTMCSDWPRVHAFHYQFIAGLGWTPAKPLPAGDMQSFADGADNGLIVVSFGSALKTIPKEMMHVLMDALRDLPQRVLMRFDGEHPANTPANVMLTSWLPQNDLLGHNNTRLFVTHGGNNGQLEGLFHGVPMLTLPVFGDQFYNARRASLRGHGLSLDLNSSSAEQVRDAITELLSDPKYRKSVQRCSRILLDMPEPRKALSFWVNHVLKFGGSHLKPSSMQLPLWKFFMLDVAAFLAVSAAIVSACIFMCCRCTAKRCCRRQSKSKQD

SEQ ID NO: 8836 - protein, 536 aa, Toxocara canis
FQIISTRSSMSFTSCLQLLCVYSFANAANILIYSPSYSKSHLISNGRIADVLSNAGHNVVMLIPEYERTKFNGTKHAKVIRIANVYDDYADEIEEFAAAFFKQQTITIRTKLKWSRKSAVVCEAVLRRKDVLDHLRSFKFDVAFSEQIEVCGLGLIRYLGIQNHIWVSSCSLTVPTTYTLGVPTPLSYVPVVEESGLGSDMSFTERAYNMFLWLQEVCVHRYAAHLQTQVFRKMDPEFPHLNDVAADSALCFVNNDEFLDLARPILHKIIYVGGIGIPLHSSPLAQSFESLMSKGKNGVVLMSFGTLVPSSSIPMEIRVDILRVFAEFIDYHFLIRADDDDNDTRQLLIDMNIHNIDLVGWIPQSDMLGHGRLRLFIMHGGLNGMLEAVIRGVPLLVIPFFGDQYHNAKAAQARGIGLSLEKYELDYAHLKGALKELLGNEKYHKAARRLSAVIRNKPNKPEEQLVKWTEFVAKYGSLPELQVEGAKLNFIKYFGIDIFAVVLFLLFTPLMTLIFLIKRTIAIFCKRGVDLTKKTE

SEQ ID NO: 8837 - protein, 449 aa, Unknown
  Description of Unknown: Mycobacterium tuberculosis H37Ra sequence
MRVSCVYATASRWGGPPVASEVRGDAAISTTPDAAPGLAARRRRILFVAEAVTLAHVVRPFALAQSLDPSRYEVHFACDPRYNQLLGPLPFRHHAIHTIPSERFFGNLTQGRFYAMRTLRKYVEADLRVLDEIAPDLVVGDLRISLSVSARLAGIPYIAIANAYWSPYAQRRFPLPDVIWTRLFGVRLVKLLYRLERPLLFALQCMPLNWVRRRHGLSSLGWNLCRIFTDGDHTLYADVPELMPTYDLPANHEYLGPVLWSPAGKPPTWWDSLPTDRPIVYATLGTSGGRNLLQLVLNALAELPVTVIAATAGRSDLKTVPANAFVADYLPGEAAAARSAVVVCNGGSLTTQQALVAGVPVIGVAGNLDQHLNMEAVERAGAGVLLRTERLKSQRVAGAVMQVISRSEYRQAAARLADAFGRDRVGFPQHVENALRLMPENRPRTWLAS

SEQ ID NO: 8838 - protein, 519 aa, Aedes aegypti
MKFKFWNFWCAVVSLVVIPTALAENILILQTLASRSHHIWNKQIFERLFNNGHNLTILSFEEEQSVPGKTFLIVKDLMAKLMADFEGDLDYTAEQSPVANIHFMYDFYNKASRLLVKEDAVRQLLAYPKTFKFDLIIHDLTMGQFLLGFVEYFGNPPLISITAFNIPPHVTTMTDAPLYTTYMPHYASSFDNKMVFIERVRNTLYWAFDLFYRNRIYMANEDKRVKQIFGGNATSVKLIEKRSDVVLVNSDFSMDYYQVLPPNVIPVGGLHVGRQEKVPPVVKQFIARANKGVILLSFGTNVASEMLGEGTNLDMFKVFRSMPDYGFIWKHGNPEELGIMPANVLVLKWVPQAAILANSRTKLLISHGGLLSLQEATWHGVPVLAIPFFVDQYSNAEKIVKAGAGVKLLPKNINEDTFKGAIKDVLENTSYYENMKQRSYLFKAQPEHPLDRAIFWIEKVLENKGLHYLRSPTPTMNIFQIYAIDMVASVLVIAFLYYLIIRRHIRRPATSDNVKPKKE

SEQ ID NO: 8839 - protein, 521 aa, Halyomorpha halys
MYLTGILSLAGTLLFASSRVVSSHRILAFLPFNGKTHHIIYRPILEALADAGHNITYVTPISPSEKHPKINYILIDDCYPGFNSKFFFENSKRTFYYLQVNAVYGITTAGLEKVYNQPNVKNLIESSETFDAVITETCFFQEANAALHHRFNAVGIEICCLGERSWINSVAGLPDNTAYMIDYRSPYTDNMNLLERIHNAYITLSISLSSLFYLHRMEQVAKRSLKYHGSEDRPPLDHILANISMILVNSHPALSYPYPTSPHVKKIAGVVINKKTKPLPEHLQNFLDNAEHGVIYMSLGTNLAIVSESTEFGDVASTFMKVFGNLKQRVVMKWDSDYPKDQVPANVIMSSWFPQQQILAHNRTKLFISHGGYSSLYESAYYGVPIIGIPYFGDQPKNILAAVVAGYCVRVNYDNVSEDSLTWAIKELLNNKRYKAEAERRSALLRDTRTSPVDDAVFWIEHSIKFPNALTPRSAYMSFVVLNLIDVKFILLIIIFSMYYVARRFIISNNLKVPTNKVKSS

SEQ ID NO: 8840 - protein, 415 aa, Sulfuricella denitrificans
MQSRNKPVILLVAEAVTLAHFARIATLAKALDPAVYEVVVASDPRYTDLEAPLGFAFHPIRSISTAEFAQALARGKPLYSVETLTQYVEDDLALLDSVKPDLVVGDFRLSLAVSAPLRRIPYASVVNAYWSPFADTAYPVPDLSMTRILGVRLAQKLFDAARPMAFALHARPLNRVRRHYGLPSLGSDLRNVYTWGDYTLYADIPEVVPTRRLPAQHRYLGPILWSTHTPLPEWWSRLPEDRPIVFLTLGSSGQADLLPMALTALSKLPVTVIAATAGNIALADVPANAYITNYLPMDIATRRAQLVISNGGSLTTYQAFASGVPVIGLCSNMDQLLNMGATERLGAGIMLRAGKASSASILEAAIAILNNPSYAQAANRVGRILVQTDAAQRFRDVVEEMLRQRSNPSSDQPQK

SEQ ID NO: 8841 - protein, 432 aa, Xylophilus sp.
MHFAFIAPPFTSHVRALEALAAVLLARGHRVSWLHQADVGGVVRDRRIDFHAVGAATHPPGGLAALVSRAARPGGPLGLRRVIHDVAAGTDMLCREAPAVLQRLGVDAIVADQMEAAGGLLADGLGIPFVSVACALPVNRDPRVPLPVMPWGYAADERGEHLNEGSARVYDWLMTPHAKVIRHHAARFGLKDRHTLSDCLSTRAQISQTTAGFEFPRSAPEPYFHHVGPLRGALAEEPPLDLALDPTRPFVFASLGTLQGGRYPLFKRIAQACRAEGLQLLVAHCDRLGPRDAAALLRHGATAVTGFAPQRSALDRADVVVTHAGLNTALDALEAGTPQLALPIAFDQPGVAARIVHAGTGLRVLPPLAGVGALRRTLRRLLDEPSFGERSRALGDEIGVSGGAAQAADITEAALAPRSAAASHEARSPAHA

SEQ ID NO: 8842 - protein, 522 aa, Caenorhabditis brenneri
MILKHFIPLIIFLIPTITTYNILVYSPSIGSSHTNFMARIADTLTDAGHDVTFLVPIVGEAKIDHLGVKSTKDVVTVELDHKIEEKPADADVKQYWRAEIDSENVKTLFTSFGDSLIRSCQRFLQRKDIFEEMKSRNFDVGIFEPLTICGVGFMHALGIRKTIIASSCVFLDPVLEAMGEPLDYSQVPGLLAKFDGDMTFWDKVENYKLSMAYQEWTWKIFDEESKMHKKFLGDSIPDWRELVSSSSLHFTNSIPYVNFPRTVTQKTIPIGGIQVDFDGIKSEKLADDWEEVLEKRTKNVLISFGSAMRSMDLPEEWRAGLLGAIKSQPNTTFIWKYESDDVSFAAGVSNIHFSKWVPQTSLLNDPRLTAFITHGGLGSTNELSHLGVPAIMIPVAADQTRNSNMLARHGGVIVLRKQDLGDPAKIEKAVKDILFDENYGENSKKLADLLRNQPLKPKEQVVRYVEFVAQFGPFPKMDLGGQGNFLSIYFVIYLPYLIFVLLFVLVLIRSLCSIKRTKEKMN

SEQ ID NO: 8843 - protein, 531 aa, Stomoxys calcitrans
MNNQRLRGIVCMLLIIVSCSFIHRVDTSRILGVFTTPPISHLLIHMAVAETLANDGHDVTVIAVNPNPLKKSKVKYIHIEEPSFNQEYAKAMVNNPDSKIYVKIAQAASVITDMANVTLHNPKMFGFLRDHKAGDFDLLIFGYFLNDFLLGLGGHFQCPIVVSFMLQPIFLLNPMIGNPAEASNVPNLFTGYKQPLNFWQRVDNFLYTTFEYQVFAPIMAWKMEEMYRYNFPPDRYPPLEEVYKNVSLVLTNHHFSQGPIRPNVPALLEIGGIQIKEQPDPLPEDLAKIMDSAKHGIIYFSLGTNVQGSNLSKEKAKMIFNVLSSLPQTVLMKWGDKDFPGEAANIIYKSWLPQDDILAHPNVKLFITHGGQGSVVESQYHGVPMVGIPFFGDQHSNMANVEKSGFGIGLKYATLNENELRASVLEVLNNPKYRENVQRFSKLYRDRPMSPRQLVSYWVDYVIRHKGAKHMQSPAVHMSWWELHSLDVIGFLVAVLTGVVWLLVFLVKLLCCRGRKASASKAVKNEKKKKA

SEQ ID NO: 8844 - protein, 541 aa, Caenorhabditis brenneri
MLPPKIIFFFSIFSIFHSVHALNILVYSPAFAGSHSNFLGKLADTLTEKGHNVTYLMPVVMVGKRDECIGVNLTKDVVIVEAGEKTREQQKGDVTNDGNLQAYWHAHMTSSNARELGKWFNEALISSCKHFHQQKDVFNQMKSKNFDVAILEPISVCGLGYVKALGIEKVILASSFVFFDAILPYIGEPLDFSSVPGAFCSSGEKMTMSERYENWLVTKEMNAGQEYTFEGEMAAYRKYSGENLPDWRELLPAASLFFVNSNPFLDFPRQVLQKTIPIGGISINSEWIKAQKLTSDWEKILEKRPHNMLISFGSMIKSSHMPEKWRNGLLQAIRQMPDVTFIWKFESDDVSFAKDTPNINFSKWVPQTALLNDPRLTAFVSHGGLGSTMEIAYSGKPSILIPIFADQIRNANMLARHNGVIHLKKDYMEDVKATKKAFEDILFDEKYKKNAEKLADILRSQPYSPKDNVIKYTEFLGEHGPFPFMDPYGRHLNYFQRNFLDIYTIWGIIYFSAAIVILFSLTRIYCMVRSLFGGKTTEKIE

SEQ ID NO: 8845 - protein, 527 aa, Zeugodacus cucurbitae
MFLPVRLLLITLILSPCAYGTYNILFMGPFPAPSHWMFMEHFLEQLLQRGHHVTTLTNQPAKQQHANLTEIIIEPPLDLVYYHPKANMFKMQFTSDFENLHLYWESGLTSTEYALNQTEVKSLIASKDLHFDLVVLEQFFHESLLMFAHKFKCPVVTLGTLGYADNMDHAMGLLTPWSFVPHLFLSDIYRMNFYQRAYNTFLSFYDVVVRHWYYLPRMQAMAERHFNDYIEGPLPHVNVLVQNISLMLINSHRSLDAPRPSMPGLVSVGGVHIKPVKPLPTELQRYLDNSKHGVIYFSLGTYIHSTDMPKGHIKILLNAFAQLKQNVLWKYENATLGTDLPSNVRISKWLPQNEILAHPNTKLIITHGGIFSTQEGVYWGIPLLFIPIFGDQHRNARKAVQAGYACSLLFDKLTSEDLVQNAQQLMKEPLYKRKALEASQLFRDNPIQPLEEATYWLEYVLRHRGAPHLKSHSAYMPLYQYLLLDVLGCTLLLLLLIILLFVVIVKVLKSCMAEKLKARNARRKKQN

SEQ ID NO: 8846 - protein, 526 aa, Haemonchus contortus
MKQFIVFLLTISLCSTDAYKFLVYSPIYGYSHTNFMGALADTLTEAGHNVTILLPIMDEGQQNKTGVKLTTKIIKVPADPRSRAMFGSVDDILSKMWTMEPSIFGLLQMAKNMTTSFVNQCQNLVNDDELMKQLADEKFDVGISETVQICGLGIFEYLKIPASIGVFSAVHMDCLSAGIGEPIMPSYVPGGMATNGDRMNFFERFKNLVSVMVGGRFFSSVFVEEIEVFRAKVGPHFKGYEELLADISYAFTNSNPYIDFPRPMLHKTIPIGGIAVATDSKKNVLSKEWNDILNRRNTTVLVSFGSMAKSVLMPDKYKKTLLEVFESMPETTFIWKYEEESSKVAAHLENVHLSTWLPQNALLADPRLSVFITHGGLGSTTELAHMGKPALLIPLFSDQTRNAHMLTKHGGGIVLKKDDLENPQKLRDSLKDILSNVSYARNAKRLAEMLINQPISAKQLFIKHSEFAAKFGRLPNLDPYGRQLSFFQYFLIDIFLVVIAALAVSIYIVVRILRKIYSVRTKSKKD

SEQ ID NO: 8847 - protein, 415 aa, Rubrivivax gelatinosus
MHEGRRSPTRKPRILFIAEAATLAHVVRSVVLATTLDAGRYEVGFATARDFRAHAEAAGLAVRELYSIGTRAYLDAVSAGRPVYPYATLERYVEDDLRVIAEFEPDLIVGDFRLSLAVSARLAKTPYLAISNAYWSPLADAPYEAPVHAATRMFGPRIVGTAFDALRPLIIAQHAWPMRRLRRRHGMPSLGLDLRAVFTEGDTTLFADVPAMVPTAAAASAARYRYIGPVVWSPPAPLPEGLDGEDGRPLVYVSLGSSGDPAALGLVVDAVVACGARAVVAAPSGWTHRHGDAVVARSVLPGSELAARAKVVVCNGGSPGSHQALEQGTPVLGIPANLDQLLNMRYLVRSGAGLSVRADELSPASLQASLRRLLSEPAFGDRARAVQREFAHYPARELFPAVVDTMLGPASGART

SEQ ID NO: 8848 - protein, 538 aa, Caenorhabditis briggsae
MISLQHIFSILFIFPIAVSSLNILVYSPAFAGSHSNFLGKIADTLTEKGHNVTFLVPVVMIGKRDECVNGVKLTKDVVVVEAGPETLSQQSGDINNDENLKAFWKAHMDSSNARSSTTWFNIAMKFACRHFHSQRDVFEQMKAKNFDVAILEPISVCGLGYMKALGIEKTVLASSFTFFDVVLPYTGEELDYSSTPGAFGSFGEKMTMWERYENWMVNKEVNMAQEDMYEGEMEAYRELSGKTLPDWRELLPSASLFFVNSNSFLDFPRQVLQKTIPIGGITMNQKWIKEQKLSEDWEKILEQRPHTILISFGSMIKSMYMPKEWRNGLLETVRSMPNVTFIWKYESDDVAFASGLSNLHFSKWVPQTALLNDPRLSAFVSHGGVGSALELAYSGKPTIMIPIFADQIRNANMLARHQGVIHLNKNDMENFRKTQKAFNDILYEESYTRNARKLADVLATQPYSPKDNVIKYTEFVGKHGPFPAMEPHGRHLNYFQRHFLDIYAVFALFYTTIAVIVAAVVWCIYRKCVKCLKVEKIE

SEQ ID NO: 8849 - protein, 222 aa, Vanessa tameamea
MGSIIKSKALAEHTRRDLIKVFGELPYTVLWKFDENIEGLPKNIHIRSWMPQTSILAHKNVKLFITHGGLLSTQESLRFGIPIIAIPVFGDQPSNAQKSVQGGHALMIDFSPEMGGPLKDALKEMLSNDRYYKRAKYLSQLFVDRPVNTTHLIQHYVKHAIETNGAHHLRSKALLYSWYELWMLDQVAFLLVILYTIYRVLKKIVACFKRDKSIKTGKEKRH

SEQ ID NO: 8850 - protein, 514 aa, Tribolium castaneum
MRSVFFIVISTFAIGQTANILGIFPMPGKSHFVMFERLLIGLAEKGHNVDIATHFPTKDPPARYNQLSLVGSLPIFVNNLSLNAFDGFTNFHMIHFMTKICGVDVCAATLNTPVLRDLKKTKKKYDLVVTEIFGSDCMLGFGHYFKAPTVSLISSISLPWAGDRIGNPDNPSYIPNYFVSTTAKMSLFERVENTIMLLYTKFLYHYFSSKESNKIAKEFFGPELPSLEELAQNTSLVIVNSHFSISHSRPTVPNFIEVGGLHIHEPKPLSKYFENLVTSDANKGIIYLTMGSMIMTETFDPEKLQGMFDAFSELPYKVLWKAKRENFPQGLKIPKNIHFENWMPQMDILCHPNVKLFVSHGGLMGSQEAVYCGVPRLGIPLFADQDNNIRASERMGLTIKVAYDDISKKTILEASKKLLEDPTYKQNAERVSKQFKDRPLSALDTAIYWVEYVIRHKGAPQLRSAGADLAWYQYYLVDVVVILASGLFVFLLLTTYVLKLVLRFIYGNHKHKIE

SEQ ID NO: 8851 - protein, 517 aa, Daphnia pulex
MNNRAFLIFTVLVASFVQSCSSAKIVVLYTVSTKSHMYAVMPAIEELAQRGHQVSIFSSFQGMAKNVKNGREFFLKEAAQLVDETEVDWFSMQKEGLNQFLTMMRYVKQMSLTSFNNLLTHPDFLEILRKREVDLFIVDGYFHEFLFPIFDHIGVPFVTHSSNSAFPNMLAAMGASKDYAFVSTSIVQLDDPITFPRRLLNVMLNEISRHIRTHYILRDLDALLQSHIPGIRSIAEVEGEASLCIINSHPMTNWPRSLPPTIVPIGALHTRPAKSLPKELKEFADGATDGLIVFSLGSFVPVSSMPKETLDTFIRVFSKLPQRVVWKWEENVPANVSANVMMVDWLPQQDLLGHNNTRVFISHGGMLGTQEAAYHGVPMLGMPFGNDQRGNVYKVKRGGWGLQLDWDKIDDRNLIDALTHLVHDSNVRANASRVSALMRDQLMPGVDVAVYWIEYVIRHGGTKHLQLSSKNLPFYQRHLLDVTLFLGSILGIFLGISYKLTRLLLSWNTKNDKIKMN

SEQ ID NO: 8852 - protein, 467 aa, Drosophila willistoni
MYFPTINGTHHIRVHKLDQLMQELSEPELDFPTNKWTEAKFVSYFYYYSSYHILADPQVQQILHNSSAHFDMIIVDTPHSDALCGFAKHFNAPMVGIAAYGAAWIVDYLAGNSAPSVTEPVSHMGYTYESTSLLNKWRNWIFLTEEWLLARLIYLPPQTKLYRQYFNDSYSNFDEIRRNFSLILVNQHFSLGRARSNVPNLIEIAGMHMCFQKDCKLDAMPEDLQRFMDEAEHGVIYFSMGIEILENWLPKHMIQTLSETFSKLKQRVVWKIDNWETRQNKSDNVFYGSYLPQQQILNHPNVKLFITHGGLLSIIETTYYGVPILSLPFYYDQFWNAQRMRLAGAGETLDLHSMNVEILNRSIHQILQNPSYATNIRRMSTQFRDQPMKPLETAVWWIEYVLRHKGAHYMRLAEHDMAFLQYYNIDLVSIILGRIGLTAIIVILLGYKLTTFFIVHSHMSLNIPLIR

SEQ ID NO: 8853 - protein, 524 aa, Bicyclus anynana
MAKNIIVFGLAIALMMSSSEALRILVFFPMYSKSHSILGHGVVNRLLEAGHEVVHVTSFPTEKPSPNLTEVNLEETGKKMKASMANDDTYKIKNMVGKGNFGDSVFFMYFTYDIHKKILGTEELVQFLKDPKQKFDAVVLEWFFSDVIAGIAPLFQCPLIWFASTEAHWQVMKLIDEVPNPAFNVDIFSASRPPLSYWERFLEFYTMMKKMLIFSVIFTPWEKTLYHETFTSIAAAKGLTLPSYDEAVYNGSFMFINSHPSIGTPFRLPQSAKYIAGYHIDRTVKPLPKDLQKLMDEAKYGVIYFSMGSNWKSADMSENMKKTLLDMFAKLKQTVIWKFEEDLDKVPANVQLVKWAPQLAILAHPNLKFFITHGGQLSTTEAIHFGVPVIGIPIAGDQYVNMRSVAKKGFGIAITLAEDMADHIYVAIQKMLESNKYKAKAKELSFIYHNRNQQPGDELVFWIEHVVATGGASHLKSPALSVPCYQKMHLDILVVLLIVLVVGIKLIRRVVKKDNSKGKKEKTK

SEQ ID NO: 8854 - protein, 526 aa, Nasonia vitripennis
MNFFIWILALSLTVTGGGADGKLKILALMPYNGKSHFYFAQVLFEELAIRGHDVTVLSHFPRKTPLTNYRDISMTSEISKGVHGVSMEDMSARSLYSKMMVFFDRGLYQVCHEGLAHLNVQKLLKSNEHYDLLITEMFNTDCFLGFVYKFGAPHVSIRTSPLSTWAVDRTGNPDNPSYIPGTTAGHPSRMNLLQRLDNLVYNVFYKIVYRIYDVYCEQVAMRYFGKDMPHLDDIARNASLFLVNSHFVHQYSKPLVPTVKEVAGLHVRNPKPLPKDLENWISGAKQGLLYLNLGSMLAASSMAAEKRQAFLEAFRQLEGYRVLMKWDDEESGVESLPGNVKLIKWAPQNDVLHHPNVKLFISHAGMLGTIEALHAGVPMVAIPFFGDQMTNARLLEERGLGIVLEYRDITFETVNRTLHRVLQPKYAKTAKELSDAFRDRPMPPLDEAVYWIEYVARHKDTAAVRLMRTPALDLHLYQYFLLDVLALIFFALLTFFWCLRQLGRTIYKLIARKHDESSKKSKKKKN

SEQ ID NO: 8855 - protein, 522 aa, Drosophila simulans
MPPIFLLLCLLPGYLEGARILAVFPLPSPSHYFFALPYLKSLASLGHEITSVSPYPQREPFRNIHDIPVPEVFENFNEVLRIASTPKSIWQSSDFINEYVLNLTKTVLNNEGVRRDILGPQKPHFDLVIMDLWRIDVLSGLAAYFDAPIIGMASYGTDWKIDELMGNVSPISYLQSPSSRFYDLEAYGQRLSHLVERTISYINYKWRHVRKQETLYRQFFPSIAERKPLSEISRNFALVLVNQHFTLGPPRPYVPNMIEVGGLHVDQNPEALSAELDQFIQGAGESGVIYFSLGTNVKSKSLSEDRRRVLLETFASLPQRILWKFEDEQLPGKPPNVFISKWFPQQAILAHPNVKLFITHGGLLSTIESIHHGKPMLGLPCLFDQFRNMDHVKQVGLGLVLNIKQMTSEDFSSTIIRLLTNKSFEETARITAARYRDQPMKPMETAIWWTEYVLSHKGAAHMQVAGKDLVFVRYHSLDVFGTFLVGALVILGIVTCLLVLTLRKCLLLVKRGKSEVIKKKIT

SEQ ID NO: 8856 - protein, 524 aa, Myzus persicae
MESQLKVLMFVHGACTSVIIIVTVFSPANTANILAVFPHQGFSHNVVYQPYILELANRGHNITIITNYPLEHPNINNISIRGSMPISNNKKNISHIEGKFMNEIQSSISTIWNFHYRGKIYEAMFTVDGVKKLLNSPSKFDLLITEHFNNELFLGFAFKFNLPFILLSSCNMLPWNQHAIGQPYSLANIPSTLTGLGTKMNFYNRAMNTISHIVQLLGYKLFRRTRDEAIIKQKLDIEVSLDQLILNASLIMVNTHFTMLESKPLVPAAVEVGGIHITPIKPLPVDIQKYIDEAENGVIYFCMGSLLLGESFSAEKRQMFLNVFDKIPQRILWKWEGELPGKPSNVMIQKWMPQRDILAHPNVKLFISHGGLLGTTEAVHEGVPILSMPMFGDQVTNIKAIVRRGAAEMMNYGDLNEDEIFVKITSMLTNPIYKQKAKELSEAFRDRPMPALETAVYWTEYVIRYKGAPLLRSATVGTPWYQYYLIDVLFVIFLFVTTIVVLLYCLIFKVLLRLLNRKSKEKQS

SEQ ID NO: 8857 - protein, 462 aa, Toxocara canis
MRLLLALHFALHCIASSAMRILQIVPGFTNSHILFNYRLAETLTNLGHDVYMWTQMEMSMVITNIVKPPNRVTELRVPIFFSDSMKTEGLKASNERVFQTMMFNEGKAYDLWWTGQEFKDMRIEACEQMLNISEEVVGSFRERSFDLAIAHFHDLCPLAMARKVGVQKVSHSNDLILLSSAKLISKMISIGDPDLWALSQQVPVLLINGEAYLDFPRPLPIGITFMGEIDAKASGLSALSGEIKRIADEADAGIIVFSLGTVSNTTNMPTRMLKSFLEAFTSFKRYTILWRLEKDVPEAKPFKHIHIMNWLPQKDLMRHPKMRLLIAHGGYNSLLETAQAGVPAILMPLFADQFINAKRAQRFGFAELLNKLTISSDIVRHTIDMVLHNSSYALNARRIASILADKPSDDRYASLSHRLRLAVSPRDYFMLKAAHKLSFVQYHFLDLLFVLIVVIVIVCRED

SEQ ID NO: 8858 - protein, 530 aa, Stomoxys calcitrans
MNFLGFVFVIIGYVCVALIQNNEASRILGVFPSPSKSHLLIHSAVAKALADAGHDVTVLATTSDDAQAHRNAPYTFVGIEGPMFDNAFAQEMVNRPLPLYRRLNYILEQIFTMANETMNHEKMLQFLHSHKAGDFDVVILGYFMNDFMLGMGAHFQCPIILSFMVQPIFPINRMIGNPAETSYVPNRFTGLKQPMRFWARVKNYLSSLFEQHILAAIVEWKVQRMYRYNFPPDRYPPLEEVYKNVSLVLTNHHFSQGPIRPNVPALLEIGGIQIKEQPDPLPEDLAKIMDSAKHGIIYFSLGTNVQGSNLSKEKAKMIFNVLSSLPQTVLMKWGDKDFPGEAANIIYKSWLPQDDILAHPNVKLFITHGGQGSVVESQYHGVPMVGIPFFGDQHSNMANVEKSGFGIGLKYATLNENELRASVLEVLNNPKYRENVQRFSKLYRDRPMSPRQLVSYWVDYVIRHKGAKHMQSPAVHMSWWELHSLDVIGFLVAVLTGVVWLLVFLVKLLCCRGRKASASKAVKNEKKKKA

SEQ ID NO: 8859 - protein, 1024 aa, Lasius niger
MENYLKPKTIWVRDKPFWSKKIKRAPLNEISSEVEKFSNYDDDRQLPRISKTIISDARKLSSFMRSPDLALLPQVELLSSDKTKFDSTKPTVLISIGIQERKNVNDNSQEDFSRIKNHRKHSHAWLIEQPFYVEEPTWINLYPDMDSSSQDNTDPYILSRGKKIFRIKDTEQAEKTIENYEDFPNKYPSRNKRLSMKSRVRRFVEMKKKSQNNTVNDNEKDQKKEINYYNFLQDTDSNNMTMTKSQDKKSYKIDKISEDRKTKEDTILFHNIFIKKYQKDKIKNVMEKLPYEFKFIKQNRTSVNDEKIINFAEQKQNIQREDISNHIKNDNSKSAKISRDKKFNNQKSSFPININKRNKRSVLLKNKNFSEVRKKYKTQEISTSSEKNVERNETDVYEQMKNKAYIDKLDDLNTYNNDTFILSSKKSRLDNRTESSNEKDIDHNKYIERPWTIQYYAYHKKLQSEEEPRNEKKEPEIDKNDTEATDSQLTSKSDSESSQINNYFNLRKKRSACRTCKLEPQLQDQWLKDIGREIQDSSLERRNKHSDILEDLSLLEPYVISRGKKASHEFENGIYSTSESRNVDDADRIKVTSFPLAKALLRMLLMEMSGCSNCDINANRLSNKRSPRDRRSSLDEIFAAYDPYYVVRGKRINLDNFLTKMQSLRNQKSASFKTDGKQIRLFYTIHKHEKISLYIDSFQVAKGKPPVVGFIPFGPAPYIKDFIGGPHYPTIRPYTYAAIAKPEGLWQKTCNTLYYIADDLVRHYYYMPNSQQIAERYIGHKIRPLHEIEKNMTIVLINTHSAFEPGIPLPPNAIEIGGLHAQPTAGEEAVTYPDSIREFLDGAENGVIVISLGTNVNWKSVGLDKLKAVTQALSKLKQRAIWKLDVELPFQVPNNVMIVKWMPQDAILTHKNVKAIWTHGGLLSTQEAIWKGVPVIGMPFFMDQKPNVEILVHKGAGVRLDFKTLSTESVSDALEKVLYNESYTKNMKRLSNEFRDRPVLPLDLAIWWIEYAVRHPHGSLESPL

SEQ ID NO: 8860 - protein, 387 aa, Unknown
  Description of Unknown: Mycobacterium sp. JLS sequence
MRVAVVAGPDPGHAFPAIALCQKFAAAGDEPTLLTGVEWLDTARTAGVPAEELLGLDPTEADDDTDAGAKIHRRAARMAVLNAPVIDALAPDLVVSDVITACGGLAAELLGLPWVELNPHPLYRPSKGLPPIGSGLAPGRGVRGRARDAVMRALTARSWRQGLRQRAEARAGIGLPAEDPGPLRRLIATLPALEVPRPDWPAEAVVVGPLHFEPTAQVLPIPPGDGPVVLVAPSTASTGERGVAEVALEALTPGEVLPAGARVVVSRLSGPDGLVPPWAVVGLGRQDELLSHADVVICGGGHGMVAKTLLAGVPMVVVPGGGDQWEIANRVVRQGSAQLVRPLSAEALATAVREVLEAPSYRAAARSAAATAGQVTDPVQVCHRALA

SEQ ID NO: 8861 - protein, 431 aa, Burkholderia ambifaria
MKILIAAKSEAGHVNPVASAASILISEGNQVAALTGEQFRRQFEDIGALFHPLPADASPDVAHVIAHDPTLRNLPEDAPQLMRFQIAVERALVDPIPLQHVMLQAVLRHFAADVILTESGFLGILPLLLGARERRPRVVICGTYFLTWERDDGAPYLGGWRPASTQAQRAQYAGLSRDHDRLFEQPLIARADELMKDLGARPLHRGVFESAIELADAYLQPSVPSFEFPRASLPASVRFIGGLPITPNLHPLPAWAADLDGRKKVVHVTQGTVANKDFGMLLAPTLAALGDDPGVLVVAITGGRPLDTIPGTMPPNARVASFLPYEWLLPKVDVFVTNGGNGSVNQALTFGVPLVTAGLSEDKADVNARVAWSGVGIDLATGHPTPDALRNAIRTVLANPGYRIEAARKAREFAAIDTRAEIIRAVTSRST

SEQ ID NO: 8862 - protein, 422 aa, Pseudomonas sp.
MHVALISPPLPSHLSTHLVLGEALVQLGHRVTLLHQADVGDRPRPPGVDFQAIGAASHPRGSLAPLLARTASRQPWAVFGVIADMARNTDLFCREGPGALRDLGVDCLIADQMEPAGGLLGDHLGLPYASLACAVPMNREPDLPLPTLPFAYPTSERERQIVQGATRVFDLMMGRQGRVIQRHAQAFGLGERRTLDDCFSPYLQLSQCLPGFDFPRHMPPAQFHEVGPLRSPSVRQQRFELELDPRRPFVFASFGTLQGSRLALFRRVAQACRQLGAQVLIAHCGRLDGTSERRLLDDGATWVTDFAPQEAVIARADAVITHGGFNTVLDCLAAGKPMLALPMVFDQPGIARRLERVGAGICLAPRLASRARLTQALGAVLADPAYRRAAERFVPIAAAAGGASTAARLVDGLAARGRDRAS

SEQ ID NO: 8863 - protein, 490 aa, Daphnia pulex
MNVKTLLFAVLVASFVQSCISARIVVVYAVCSKSHMIAVMPAIEELAQRGHQVTVISPFKGIAKKGATQFLTMLTYIKEISLKACDSILNLPEFREIVEKRDADLFIVDGMFHEFLFPIFDHIGVPFVTHSSSSAFPSTLVAMGAPIDYASVPLPILDADDRMTFSQRLMNIIPNEIMGVLITHYIKKDLEALVKSHFPGVRSIAELEGEASICIINSHPMTSWPRSLPPTMVPIGALHTRPAQPLPEGLKEFADGATDGLIVFTLGSFVPVSSMPKETLDTFIRVFSKIPQRVVWKWEADAPLNMPSNIMMVNWLPQQDLLGHNNTRVFISHGGMLGTQEAAYHGVPMLGLPFGNDQRGNIAKVKRGGWGVQLGWDKIDDQSLTEAFTYLIHDPNVRANASRVSALMRDQLMPGVDVAVYWIEYVIRHGGTKHLQLSSKNMPFYQRHLIDVCLFVTSVLSIILYLIFIIGRKLFRSCLSRSKNVKTKKN

SEQ ID NO: 8864 - protein, 527 aa, Vanessa tameamea
MASRKMILNVILILMVSSSEALRLLVFFPLYSKSHSILGQGMVSRLLEAGHEVVHITSFPRDKSEANLTEINLQSLGVKMKAEAEKLEQFKLKNLVGKGNFGDSLFFIYFTHEIHKQILDDPALVKLLSDPKEKFDAVILEWFFADEIAGIAPLFKCPLIWFGSTEAHWQVLKLVDEIPNPSFTVDLFSNSTPPLSFWERIRELYKVLKKSLIIGALITPFEKTIYNNVFNKIAAERGVTIPSYDEAVYNGSMLLLNSHPSIGTPFRLPQNAKYIAGYHIDTKVKPLPKEIENIMNEAKHGVIYFSMGSNLKSIDMSDYMQKSLLTMFSTLKQTVIWKFEGDLDNVPTNVHLLKWAPQPSILAHPNLKFFITHGGQLSTTEAVHFGVPVIGIPVAGDQHANMGSVTKKGFGILVNLAENMAINLQIAIKEMLENTSYRTKAKELSHIFHSRQQKPGDELVFWIEYVVNTRGAPHLRSPALSIPFYKKIYLDLLVLSMLLLYLLVLATRRFVCKRCRRASKSKKEKKN

SEQ ID NO: 8865 - protein, 222 aa, Diuraphis noxia
MGSMLRGESFSAEKRQMFLNVFAKIPQRILWKWEGELPGKPPNVMIRKWMPQRDILAHPNVKLFMSHGGLLGTTEAVYEGVPILSIPMFGDQLSNIKTVVSRGAAEMMNYEDLNEDEIYVKITSMLTNPIYRQKAKKLSEAFRDRPMSALETAVFWTEYVIRHKGAPLLRFATVGTPWYQYYLIDVLVVIFLFVTTIFLLLYCSIFKFLLRLLIRKPKEKQS

SEQ ID NO: 8866 - protein, 516 aa, Halyomorpha halys
MKLWMLPLLLVAYTEAARILAFFPIPGKSHHYVFRPIMAALGRRGHEVVYYTGFPYERTVPPGIKQVDLSDELPDLYSSVDITDFMTSSIFEDVKKLFGYSFFYSPFILECPKVQKLIHSDEKFDVVLSESYFIQEYLSAFMHKFNAVGIDIISLGDFGWMNELVGLPDNPSYQVDYKAVLTPNMNFWERVYSTYVNVVTTSAGYHYLNQMENFVDKYFNYTGHESRPPFMQLLSNRSLILVNYNNVVGYPVPKPPHRKDIAGVTITPRKPLPKQVKKFMDDALNGVIYFSLGSNVNVSHPTNRKMVKVFMKVFEEVPQKILMKWETTTFEGKLPKNVHLEKWYPQQDVLAHNNTVLFITHGGYLSLVEAVHFGVPVIGIPYFGDQAKNFRFVEEAGIGKMLKLNEINYDNLSRMVKEVLSNKTYKDEMTRMSKMFRDRLVEPVDEAVFWIEHVIKYPDVLKPKALSMSYIQLHLIDVMLFVISVLLAVVFIAWKSITIIVRLFKRKSTPSKEKTS

SEQ ID NO: 8867 - protein, 530 aa, Stomoxys calcitrans
MNIQGQTFVGWVLNALIGFSILQGLEAKRILSVFPSPSVSHLLIHMAVADTLANDGHDVTVIATIPNRFTKSKVKYLHIEGPMFDHGFANHMINNPSHVYVKFAHTVDQVLDMANATMNNRKMLQFLHDNKAGDFDLVILGYFMNDFMLGLGAHFQCPIVLSFMVQPIFPTNKVIGNPAEASYVSSLFAGFKQPMDFWQRVINYLSIALEYYVLSPVMDSKVRDMYRYNFPPDRYPPLEEVYKNVSLVLTNHHFSQGPIRPNVPALLEIGGIQIKEQPDPLPEDLAKIMDSAKHGIIYFSLGTNVQGSNLSKEKAKMIFNVLSSLPQTVLMKWGDKDFPGEAANIIYKSWLPQDDILAHPNVKLFITHGGQGSVVESQYHGVPMVGIPFFGDQHSNMANVEKSGFGIGLKYATLNENELRASVLEVLNNPKYRENVQRFSKLYRDRPMSPRQLVSYWVDYVIRHKGAKHMQSPAVHMSWWELHSLDVIGFLVAVLTGVVWLLVFLVKLLCCRGRKASASKAVKNEKKKKA

SEQ ID NO: 8868 - protein, 516 aa, Drosophila willistoni
MLVLRFFGFLLLIKYLDGARILAIFPYPGPSQYINVVSYLKALASRGHQVDSVNAFPQKQQVNNFQDIPVLEVFKGYEDLITDLGDPMNIWEENNFENGFFLNITTKVLENKEVQKRLLSKGKAQYDLIILEALRADVLYAFGAHFNAPIIGISTFGTDWDIDKLVGNTSPLSYIPLITAGLSDRMTFSERISNFVKTSVAWLNYNWVHMPKHEELYKKYFPHIADKFQLSELAKNISLVLLNQHFSLSFPRPYVPNMIEVGGLHIAHKPAALPKEMEDFIQGAGKAGVIYFSLGSNVKSKDLPEEKRRMLLETFASLPQRVLWKFELDHLPEKPANVFISKWFPQPDILAHPQVKLFITHGGLLSTIESIHHGKPVLGLPFFYDQFLNIARAKRAGFGLGLSHADMTGSEFKTTIERLLNEPSFMATAQAMSARYRDQPMSPQDTAIWWTEYILRHKGASHMRVAAQDLNFFAYHSLDVLATLIGGAFVAIGLVLFALTKVLRFTQGTKTKQKTM

SEQ ID NO: 8869 - protein, 380 aa, Tsukamurella pulmonis
MRVAIIAGSEAGHALPGLALALRLLAAGHEPVVFTGRQWQGVGARYGIDTRELPGLAARPGDDDGDAGAKIHGRAAYIATRVMPGIEEVRAELVVADILTPGGGMAAELLGLPWVELSPHPLYLPSAGLPPIGSGLAPAQTPRELLRDAVLRAFTARDIRNGRRQREAARAGIGLPARDGGPAGRLVATIPTLEVPRPDWPARTHLVGPLTLEPTDELCPVPDGAGPLVMVAPSTAATGEQNLAAIAVDGLRGEGLRLAVSGLTPPVFDEPWVASGFGRQDDLVARADAVVCGGGHGMLTKALTAGKPVVVVPGGGDQWELANRVARQGSGVLVRPATADAIRAAVRRVVAEPSFARAARAAAATAHRVADPVLVCEAYR

SEQ ID NO: 8870 - protein, 517 aa, Rhopalosiphum maidis
  MOD_RES (268)..(268): Any amino acid
MVNTIVTYYLLVAATVTAYYHASAARILGVFPHYGYSHHMVFLPYLRTLADRGHDVHVISNFDSSHPNITDISVEGSMPMFNNNVTLPDNAGHFGIVSALTNMFILYGLAKTTEAVFDAPAVRSLLDHHTASFDLVIAEHFNSELPLGFAAKYRVPFILLSSCPLTPWTMSLVGQPQQIAYKPSVSSGLPERMDLGQRLTNTAVAVVSAAMFRLMNRPWSQRTLRKRLGLDVSLDELASNVSLVLVNTHWSLNGVSPAMAAVKEIGGXHVIPPKQLPVDIQKYIDEAENGVIYFCMGSLLRGETFSAEKRQMFLNVFNKIPQRVLWKWEGDLPGKPSNVMIRKWMPQRDILAHPNVKLFISHGGLLGTTEAVYEGVPILSMPIFGDQMTNIKAVVSKGAAEMMNYGDLNEDEIFIKITSMLTNPKYRLKAKQLSEAFRDRPMSPLETAVYWTEYVIRHKGAPQLRSAAVGMPWYQYYLIDVLVVIFLTVTTSFVLLYCLIFKVLLKLLNRKFKQKKS

SEQ ID NO: 8871 - protein, 444 aa, Spirosoma linguale
MKTALFIMFPVPSHYNICFGFADSLRKQGYRVVFAGTPNLQTHIESQTFEFVKLPYMQEIVVANWRVALGLFIVSKFEKKDKRVRYREFLTSIDAVQYVCKTILPNEIYIDEHLNVYYLLLKATYPNCTLVNTKLPTHRVLGIPPLTCSHPFQDTARHRLYAWWLWQLFMLKYYYGSWRKKIALLGVDEQLFLRRVTAKMGIQLNAYINPYNLLHDGLVDVPIIHLVPRELEYSWYKMGANEQFFYQPYQRKPDRDDSLFWEQIKPLLDKRERGEIQLVYASLGTLSEGNTKPATLFLNRLIAAFNDLPTTHLIVADKRLFANKPENSPANVHIVDWAPQTELLPYCDLMITHGGTNSILECVQAGVRLVAYPLNLTADHPGNTARMVSNGWGEQGNLRGATQSTIRQKISQMLSDSSSIEKRKQILMPPINDWQPKMDLAKSR

SEQ ID NO: 8872 - protein, 519 aa, Aedes albopictus
MKHKFWSLLCAVVTLVVIPAAVAENILFLQTLASRSHHIWNKQIFERLFDNGHNLTILSFEEEQSVPGKTFLVVKDFMAKVMKDYEGEWDYTAEQSAFTNIHFMYDFYNKASRLLTKEQAVLQLLEYPRTFKFDLIIHDLTMGQFLLGFVEHFGNPPLVSLSAFNIPPHVTTMADAPLFTTYMPHYASSFDNRMFFMERVRNTLYWTFDLFYRNRVYMANEDKRVKLLFGTNATSVKQIEKRSDIVLVNSDFSMDYYQVLPPNVIPVGGLHVGRKEKVPPIVKQFIARANKGIVLLSFGTNVASEMLGEGTNLDMFKVFRSMPDYGFIWKHGDPEALGIMPANVLVLKWVPQAAILASPRTKLLISHGGLLSLQEATWHGVPVVAIPFFVDQYSNAEKLVTAGTGVKLLPKDVNEVTFKGAIQEVLENPSYYENIKQRSYLFKAQPEHPLDRAIFWIEKVLENKGLHYLRSPALDMNIFQIYAIDMVAVVLAIAFLYYLIIRSHLRRPAAGGYVKPKKE

SEQ ID NO: 8873 - protein, 493 aa, Drosophila obscura
MLGICSTVEVQSHHILGLFVNVHRSQLLVHMAVARALLQRGHQLTLVTTLPLAEVELQGNVTHILVPWEQPADEGNLGTSSDWLLRLQRMFNRLEQSGDLLDQPAWKDFQNLSPKPHFDLLLLGYHFNDHLLGVAAHFNCPAVIVSTQQPIGFVNSLMGNPEERWYVSQPYDSRQRNGISAWLFGVWEKLMEMVARRVLQKIYSSHFPEPHYPPFETMRRSVVLALNNHHMISEGPIAPLLPSMIDIGGILLEQKLNETLPEVSRNRSLIIFSLGTRFTWKRSPGHLVKTFTKAFAQFPDYDIYWTYDGLNASEIMSHHSHLKLAKWWPQRHLLGQQQTCLFITHGGKGSLTEALYNGVPMLGLPLLGDQRTNLQKMEAKGWGSTLSMQNVSHVEMSKAMGRILSHSRYSVNISTASHLYRDRPRNASDLATYWLEYVIRHRGAKHLYSPARKLNFIQYYSIDVYALIYGGLLLLIGIFSRINQKISVTRSIV

SEQ ID NO: 8874 - protein, 440 aa, Papilio machaon
MLSNKNVQHVWKTTKFDIVVTEQFNSDCSLGLAHHLKLPVIGLASHALMPWHYSRFGVSFNPSYVSHMFLSGGTKPKLYERIERVLFDSYLRLIYKFYCQRIDQNTLAQYFDDIPPLEELGRNIKFQLVYSYFVHFGSSLYPQNVIEVGGYHVQKPKKLPDDIRKFIEESQHGVIYISFGSMLRSATTPREKIETIISALRELPQRFIWKWEEDSLPGNPSNIYLSKWLPQNDILNVILETDKLECVVVSKWKGEEMCQKSAKWKSVISAHFSGRHPNVLAFYSHCGLLGTSEALYHGVPMLAMPIFGDQPGNAAAVEESGLGVKIEFMELTKKELLEKFKQILNPEFRAKVKILSQAWKDRPISGIDAAIHWTEFAARYPNFTYRSAAADVPLYQYLGLDILLILFGIPLLIIVLFLRYIFNKKKTNSTSKNKHKSKKE

SEQ ID NO: 8875 - protein, 1100 aa, Neodiprion lecontei
  MOD_RES (216)..(216): Any amino acid
MQVKMKLTHLLLVSLSCIICFGRHAKGARILGMFPLQGKSHFAMFKEVLKSLANAGHQVDVVSHFPLENAPPNYTDIISLRGTGIVVHNSMTYELLQSISSAPMEVVIKLAGNDVCESLGKPEMQNLIKNPPTDPPYDLVITELFFASCYFAFGRHLKVPVIGLSSATIMPQANAPLGNPLNTAIVSEISDRPASHMNFRQRLTNTLTTVYMNLQXRYYMKAQNDMVKKYFGPDMPDVEELERDMSLLLVNTHPIFHGIRPLTPAVVEVPGLHIHDEHSTMPVHLMKWLDDSSDGFIYFSFGSMIQFESFPSADVVEMYAAFAKVAPLRVLLKVADPDKLPPGCPDNVLHLPWVPQVQVLKHENIRGFITHGGLMGLQEAVAYAVPLIGIPLFGDQMSNINICVERGIAVRLNYMDLKADEIVAAIKTVSQDPKYKKNMDAASKQFLDRPKSPHDTAVFWIEYILKHGADSLRSPAIKLTWWQVALLDVYGSVLAALLLVLYAFKIIFSCIVRRAFGTGKMSPLAKKTNYQIEWESSMVYYFYSKKTHVAGCLVADYRVLMTRTILRRQIELQRFKMWSRYCTLVLFLHVITAVPGSNGARILGMFPLNGKSHFAMFEAVMKGLADRGHRVDVLSTFPQKKPYPNYTDLSIAEWVPGIVNNMTYDFVLKIAGSSEETFIDHTGNHVCDYLKLPHLQKLINNPPDDPPYDLIIVELFYANCYLAFGRHLNVPVVGLTSSPLLPYINEPLGNPLNTAYVPEIDDGSVSHMNIWQRLKNTLVTWMKIYQSRYFTQGQDETVRKYFHPDMPGIRQLERELALLLVNSHYSVNGIRPMTPAIVEVGGLHVKNDSTELSKELKKWLDESEKGFIYVSFGSMVTIESFPEKTLLEIYTAFKKIAPIRVLLKVANAKSLPPGLPSNVLTSNWVPQVQVLRHMNIKAFVTHGGLMGVQEAVTYGVPLIGVPLFRDQPVNIKNCADKGAAILLDHRDLTADKIVASVNAVTHDPSYKKNMKVLSDRFLDRPMRAGETAVYWIEYILKHGGDALRSPAVKLTWWQLALLDVYGSVLAALFVLSYTAKLILSAIYRRLLYRNRTRSATKKRN

SEQ ID NO: 8876 - protein, 486 aa, Athalia rosae
MVVMKGLADRGHRVDVLSPFPLNKPHPNYTDLSIADDVPRMTNNMNYELVKAISGSSAGLFIHMTGTEICRLLELPLLQDLINNPPEDPPYDLVVTELFYSNCYFAFGRHLGVPVVAITPSPMIPYANEPLGNPLNTAYVSDIEDDSIKNLTFWGRLKNTIITWYRIFQSRYHIEVQNDYVKKYFGEDMPEVRQLERELSLLLVNSHHSLNGVRPFTPAVVEVGGLHVKKKKKSDLLPSNVKKWLDENDEGFVYCSFGSMVKIESFPNETVLQIYSAFSKLSPIRVLMKVAVPESLPPGLPKNVMTMSWLPQEEILMHKNIRAFITHGGLMGVQEAVTYGVPLIGVPLFRDQPINIKNCADKGTAVFLDYLNLTEENILGAVNKVLKNSSFKTNMMDLSARFLDRETPALDTAVFWIEYILRHGGDTLRSPAVKLTWWQLALVDVLAVIVASIVLALYLIKIIVSMILSRLAPTKKPVLTTSKKSN

SEQ ID NO: 8877 - protein, 1466 aa, Ctenocephalides felis
MLRLLFCALLFGALNVEGAKILMMFNAISRSHYILGEALGLGLAEKGHEVTMISPFKKNNNHANFKEIILEDAFDSLLAKEMQNSLVDNKNRNMWKMVFRMAYIGADGTNKTFHNTEVQKLLKSGQKFDVFLTEWFMNEALLLMAQHFNAIPMVMSTAGSSGWTNKMVGNPFNPAYDINLILPFTNPLSFSERLISTAFMVLEEILYCRHMSHQSALYEEHFRSLNGRDRMNEPDLPSIVTNISLLLLNSNLAVSNARAYVPNVVSVGGLHVNPGKLPDDLQKILDDSPQGVIYFSMGSNLKSSNLPVETRNGILRTFAKLNHTVLWKWEDDKLPNQPKNVIIRKWMPQQSILAHPNVKLFITHGGLLSSIEALYFGIPLVGIPVFGDQPMNMARAVKSGYGIKVDLDTISEEILDEAISNALENPKYRERAQFLSNIFRDQDQSPMDKAVSSIEYVLRHKGAPFLRSPAVHMSVYQKILLDVIAGLLAIILLPIFILYWVFKKIVKKCCRSSKVNNAKKRNAQVYGAKILIVFNVVSRSHSNIGHALGIGLAKSGHEVTMFSPYKWEESHPKYTVHILTEVFESKPAQEFRNNTFGLNNKSVVQMLKMMTKLGQESALGTFYHPEMQKLIKSRAKFDMFISETFMNECLYSLANYFNAHSASVSTFGTSFWTDKMTGNPFNPSYTSNTFLTFGSPKTYLQRLGNTVQTVLDYYLYWKHLSDQQPLYDNFTSTLYNGDMSKVPSFTSVITNVSLVLLNSNFVVSDAQAFVPNMINIGGIHINPKKLPEDLQNRLDNANEGVVYFSLGSNLRSAQLPNATRDAILKTFSKLNKTVLWKWEDENMPNKPDNVVILPWMPQQAILAHPNVEVFITHGGLLSSLESLYFGKPLVGIPVFGDQPKNMVRAEWSGYAVKIELHEITEERLTHALSEVLTNPKYRLRAQELSRIFRDERQTPVEKAVSSIEYIIRHKGAPFLRSPAAREALGIALADNGHKVTMASPFKRAENHTNFKEIVLEGLIEKSINAMYNFESNDRSALSMIKYIFDVRNKFAELTMQHPEMKKLANSSKKFDLFITEFNLNECIFGFGYHFRTINIVFSTIGTNYWTDEMVGFIKSPAREPNIILGYTVPMTYFQRFVNSLFYIGYDYLDRSRMNYQEQLYKNFFQPLQIGSPTQFPSLSDLYRNFSLILLNNNVAVSKPTPQYPNMINVAGMHIKLQNLNEDLQILMDQAREGVVLFSMGGNLKSSNLPKEYLNIMLTCLGKINQKVLWKWEDEHLPNKPDNVIIRKWLPQQDILAHNNTVAFITHGGMLSKIEAIYFGVPLLGIPILGDQFMNVAEAVQDGIAVSLDLNKLTENSFDTALNDILYNSSYRERVQKLSKIFRDTPETPLQKAVNSIEYVLRHDGAPFLKAPFDDMPMYQILLIDVIGGIIVIIVAIIWIVYILVRFLITKKNSQKNSKVKKSKKIS

SEQ ID NO: 8878 - protein, 411 aa, Necator americanus
MYRLIYIFLLISTARSLNIVIYLSLVGKSHVDFTSALINSLVDRGHEVDLLIARQNTLVTSNGTHKASKVSTFSFPGQSPWIDVEHLKTPFDLQRRKPQMFLEYVRIASQLCRYGLASGEPASFLRRKKYDIGITSDYDFCGYILFHQAGINTVASFTATNLLSHQAFSLGLPSPASCVTGNFDLSSGSHRPGIFERATRLLKAMRFVFVERPEYEELGDALIREFFGKGFPTIGELLHNSDLVFVNTDEIIEKPRPLSHKVKYIGGIALSEPKPLTKDMRNLLGNYTKNVVFSFGTQVPTENIPLHIRKMFVEAFAHFPNVNFLWAYKSQGDEGNMFATVPNVKLVEWLPQTDLLNDPQVVGFISHMGLNSFLEASRAGVPIIAIPLFADQTHNAHIGMPHLDSVRYSLF

SEQ ID NO: 8879 - protein, 777 aa, Copidosoma floridanum
MCEEVMKGLAARGHQVDVYSHFPLSKPVSNYTDFSLKGTVQELVNNFTYDDVVSSKASTSFIVNVAMDWMKSMCRLLDHPYFQKLIKNSPRDPPYDLVILEFVIPSCFIPFGRHLNVPIIGIVTTSTFDLIYYPQGNPFNLAIDSSLFSPYSTPMSFRERLENYIAHHVSIIIYRFSGEKLQNECIKKVFGPDYPGSPEILKDFSFILVNQNKAINGIRPLTPTIVPVGGLHIVDSNETLSQDVQKWLDESEHGCVYFSFGSMVLLETFPLPLIQELYRAFKNIAPTRILLKVVNSKLLPDGIPSNVMIKPWLQQIKVLKHKNVKLFVTHGGLMSTQEAIYYEVPMIGIPLFADQYMNIDGYVKLNIAVGINKHEISEQSLTEAFKEVLGNPIYKESMKNVSRKFRDNLVNPIDTAVYWVEYIHRHGKDALRSPLVDMPWWQIYLLDVYGVIVAAIAVVIYLLIKLCLLLRVMWRKVYRQMSLKLFSVPICFVPFGRYLNVPIIGIITLPTYDFVHDPLANPLNLATDPSLFSQYSSPMIFTERLHNFITYYVVKIVYKFSGDKLHSECIRKVFGADYPGSPEILKDFSLILMNQNKAINGIRPLTPAIVPVGGLHIVDSNETLSQDVQKWLDESEHGCVYFSFGSIVKLETFPEPIIQELYKAFENISPIRILLKVVDHLDQESMKNVSRKFRDNLVNPIDTAVYWVEYIHRHGKDALRSPLVDMPWWQIYLLDVYGVIVAAIAVVIYLLIKLWLLLRVIWRNLYHQMSLKQVKKE

SEQ ID NO: 8880 - protein, 382 aa, Oesophagostomum dentatum
MDPHVDMVGHHSALVQIPYISKYYDPNDYLDLDIKGSALWATPRMEGRCFSMEDLEKFMRVNEKLCRGIFEDTRFVRALRDCSFDVALHEAYELCAVAVLEMIDVKNTIVVSALGVTPYIQEIAGFAANPSFIPGMFTTYSDEMTFWERMDNFKFEIEMYYWRASWEKHIWKLANKARPRFPELRRLLKEKTGVVLINVNEITESPRPTANILRYIGGATIREPRKLNERLNAILNERRENVYFSLGSLAQSKDMPMHLKQEVIDAFASFPNTTFIWKYEGEGDAILFEKYPNIYPIKWLPQVDLLADDRLSLFITHAGMNSVLEATFYGKPMIAIPLFVDQILNAKNMRSRGLAVMIDMHDLSRDTLVSAIHETIRANRYA

SEQ ID NO: 8881 - protein, 533 aa, Copidosoma floridanum
MAFTTNFYVYAAFATFLFPSTTPNLAHGLRILGLFPYHSKSHFIMCEQVMKGLAAKGHQVDVYSHFPLTKPVSNYTDFSLKGTLQTGVNNVNYNNVVSNETPLRYLVNKLMNDIKLMCQLLDHPYFQKLIKNPPRNPPYDLIILEFVIPVCFIPFGRHLNVPIIGIVTTSTFDLIYYPQGNPFNLAIDSSLFSPYSTPMSFRERLENYIAHHVSIIIYRFSGEKLQNECIKKVFGPDYPGSPEILKDFSFILVNQNKAINGIRPLTPTIVPVGGLHIVDSNETLSQDVQKWLDESEHGCVYFSFGSMVLLETFPLPLIQELYRAFKNIAPTRILLKVVNSKLLPDGIPSNVMIKPWLQQIKVLKHKNVKLFVTHGGLMSTQEAIYYEVPMIGIPLFVDQNMNIDAYVKLNIVIRINKHGISEQSLTKAFKEILGNPLYKESMKNVSRKFRDNLVNPIDTAVYWVEYIHRHGKDALRSPLVDMPWWQIYLLDVYGVIVAAIAVVIYLLIKLCLLLRVMWRKVYRQMSLKLVKKD

SEQ ID NO: 8882 - protein, 523 aa, Ceratotherium simum
MARSWTLLLICFLLPGILLSEAAKILTLSLLGGSHHLLMVRASQILQDHGHNVTVLLQRANLLISGFKEEEKSYQVIPWLLPEDHYKEFMKFFDFFMKEALAGRDKFENFLKAMELMGLQCSHLLKRNDIIASLKDENFDLIFVDMFDLCSLLIPEKLGKPFVSIISTSFGFMDFGLPSPLSYVPVFDSLLTDHMDFWGRVRNFLMFFDFSIRQWRIHSTFDNTIKEHFPEGSRPVLSHLLKKAELSFVNSDFAFDFARPLLPNTVYVGGLMAKPVKAVPQEFENFISKFGDSGFVLVALGSTVNIFQSQELLKEMNSAFAHLPQGVIWKCKPSHWPKDIKLAANVKIVDWLPQSDLLAHPRIRLFVTHGGINSIMEAIQHGVPMVGIPIFADQPDNLLRVEAKKFGVSIQLKQIKAETLALNMKQVIEDKRYKSAAVAASIIRRSHPLTPAQRLVGWTNHILQTGGAGHLKPHAFQQPWHEQYLLDVLSFLLVVTVGTVWLCGKLLGIVARWLFGAKKLKKA

SEQ ID NO: 8883 - protein, 527 aa, Caenorhabditis brenneri
MRVPLLLLLLFATSSLCYKILVSVPKFGYSHMKTMGKLADILVESGHDVTFLMPVDVPIPQNGTELATVVLVPPTDAISEIMGAAMKSGAVANLWTHSANSKQGIMWSTDMIGQVSYHNTKNMIENKALIQQMKDEKFDIGITELFDFSGLAFFEVIGLKNVIGAHTTSVFEGTLMATGAPILPSFVPGSQTFTDDSGSILSRLNNLYMTYWSYEFQNKIQGFAQKALDEHYGKGKAPKIWNLVKEITWFFVNSDPIFDFPKPLPQNIIEIAGISVSKTKPLGKEWDEILSKRSKNVLVSFGSIASPTTMPEAVKKSVVDSFAAFPDVTFIWKYDDTESGLTSHLKNVHIVKWMPQNDLLADKRITMFWTHGGMGSLMESAQKGVPLIVVPIFGDQMRNAQIARRHGVTVIYDKMELSNTKKLISTLKEVLENPEYKKSADLLAQILATERVSPRQKIVDTVELAGRFGQMPRWTSAGRDFSMLKYFNLDLVLIFIFMVISLIFAILVVIRRILVKLGFSGNKEKSE

SEQ ID NO: 8884 - protein, 527 aa, Caenorhabditis remanei
MKLIAVLFVVLLILPSTSAFNYLVVSPQFGHSHSTFMGKVADSLSDAGHNVTILNILIASKFRGRPYTKSTKDIVYMETTEELDQISSLMESGDFSRYWTEEGSMLETIPSYQGFMKIFEKVYINVKQQTDVLDELKESRPKYDVILFESFMFMAKAIQEYLEIPVFIPVTSVTHDGRLAELCGEPASPSYLSGYFTNYGNIMNFQERLTNTISYFLGKIILEYPKWKTLHDPTKRLELDSVYHHAPYVFVNSNPYIDFPRPMLAKTIQVGGLTVDVKKLRSEKLDEKWNTTLEARPHSILVSFGSMFKSIYMPESYKLNFVKVMKSFKNVTFIWKYESEETGFSQGAENIVFNKWIPQTALLADSRLSAFLTHGGLGSVNELSYLGKPAILCPLFADQLRNAKMLARHNGAIEISKFDLADYKTLQSAIHRILFDKSITENALNLAKRLENQPMKPKELLVRHAEFAAEFGEQPGLDCNIRNMTFIEFYLLDVFGFLASIVLLVLLVIYFAAKKITGMLVKKLKRD

SEQ ID NO: 8885 - protein, 489 aa, Propithecus coquereli
MAGQRVLLLVGFLLPGILLSEAAKILTVSTMDFKEEEKSYQVMSWLLPEDHQKELNKHFNFFIEEAFNGRGIYENFLKFMEQLAFQCSHLLSRSDIMDSLKNENFNLVIVDSFDYCHFLIAEKLGKPFVSVLTTSFANVNFGLPSPLSYVPVYNSLLTDHMDFWGRVKNFLTFFIFSRKQWQVQSLYDNTIREHFPEGSRPVLSHLLLKAELWFVNSDFAFDFARPLLPNTVYVGGLMAKPTKPVPQELENFVTRFGDSGFVLVTMGSMVNITSFREVLKEMNSAFAHLRQGVIWKCKHSHWPKDVNVAANVKLMDWLPQSDLLAHPSIRLFVTHGGQNSIMEAIQHGVPMVGIPIYGDQPENMVRVEAKKFGVSIKLEELKAETLALKMEQVIEDKRYKSAAVAASVIRRSHPLTPAQRLVGWIDHILQTGGAAHLKPYAFQQSWHEQYLLDVFMFLLGLTLGTVWLCGKLLHVVSRWLCGARKLKET

SEQ ID NO: 8886 - protein, 529 aa, Neodiprion lecontei
MRPLSCILLFAVTSVVLLSDAYRILGIFPFNGMSHFVMFERLMKGLAEHGHQVDVVSHFPLKKPFPNYTDVVSLAGTKPNLVNNMKVQISKSDEKLPSAAVFFASVFGIELCKLMEHPEFQKLIKNPPTNPPYDLLITEIFGANCYLAIGQHLKVPVVGVVAAAMLPWANEIVANPDNTAYIPNSFSDFDEKMNFWQRTQNTLSNIWSKWQFNRISEGQNEVIKKYIGPHAPTVREAEKNVSLILTNSHYSLNGVRPFTTAVVEVGGVHIDEKEATFTNDLLQKFLDDSSDGFVYVSFGSMVKIESLPKEILANMYASFAKLAPVRVLMKIANPEELPPGLSSNVLTLSWIPQLAVLQHKNTRAFVTHGGLMGTQEAIYYGVPMIGIPLYGDQIQNIRVYAKMGIAVHINNEEITEENLDAAFRAVLNDPSYVNAVKRMSERFRDRPMSPLDTAIFWVEHVVRHGGRNLRSPAMDLTWWQIELIDVYSFLLSSIILALYVIVAMVKKVKSLFYPGDAKCEVTSHDKKVK

SEQ ID NO: 8887 - protein, 519 aa, Haemonchus contortus
MILLYLLTVYITLCHSYKVLVINPKMGYSHMNFMGRLADTIAEAGHEVVTLQPVMDGSLASNGTTKSRLIQRGPFDDLARPTNSEDMKLVWTSGAKNPIGLVMFVPMISNFAVKTLSHLLDDKPLLEQLKAEQFDVAITELFDFIGIGVLNAVGVKNIIGAHSSVIIEGTALAIGVPVIPSFMPASFSVTDDSTDLWTRATNLVFTGASLYFQKGIASAIDRLLKEKLGSNAIPVWDTVSNMSWIVDNAESLLDYERPTLSKVVHVGGLSVHKPKPLNKEWDDVLNRRPHTVLISFGSVARSALMPDLMKKTILDVIKSYPKITFIWKYEEPDDKIFKGIENVIPTKWMPQGDLLADNRLTLFVTHGGINSMMETATLGKPVITIPLFADQSKNAKLMQKYGFGIIVEKTELLGGDGLREAIGRVIKDKTYQISATRISRLLSRRPFSPEDKLVKTVELAAEFGNIPELKAAGRNLSFIVYYNIDLLVILSVVFLSVFGLILYITLRFSVLLRLSYKGV

SEQ ID NO: 8888 - protein, 501 aa, Neodiprion lecontei
MLRSFVSATLILLAAFWHYGYASRILGVFPTPSISHQIVFRALTLALRERGHQLVVVTPDPVNDPMLTNYTEIDLHFLYADTDGGENWIETLAKERWTDIQDAYLSTVLTQTELILDHPELKKLYAPNNGQKFNLMMIEMLYYPALLPLATRFDVPVVGITSLGLSLSIHYAIGNPIIPSHSSNWDTEEMIFGEAIFWQRLKNFIWVWKFLYKYRTRYMPAQQALARKYFGNDIPDISDIEKNVSVVFVNQQTPISYLRPNIPKVIDIGGFHIAREIKPLPKDLQKILDDSTQGFIYMSLGSNIKSVMLSNEVRREFIAAFSELPYTVIWKFEDDFLANKPENVIIMKWTPQQSILAHPNLKVFIYQGGLQSTEEAVSHGIPVIGLPVFTDQHVHANKMLQEADDGLAEFAQGQTLRFTEERDLVDRACDTSQRSSTSAVHYGRRAVVSASRYGHCFCYFHRISHNFKFGNNCVLQDGQSYSCNDSPNQSEGQNKLTRPRD

SEQ ID NO: 8889 - protein, 507 aa, Trichogramma pretiosum
MNYITVFLILNCATGLMMCDAYRILGVFPFAAKSHNILFESLMKGLAKRGHQVDVVTHFPLSKPPENYRDIINLNGTMENLVNNFTIEFVNQMAGDIVESIATNYGNRICEFMGLPEMQQLIHGPLPNPPYDVVITEVFGANCYIGLGRFFKVPVVALSSATEYPWIADFTGNDDNLAYVPNAFHVGVEEMSWWERVVNVYGHFKALIQFHHLTDYSQTQSMRKYIDANMPDIREVVRDVSLVLVNSHPILFGVKPLVPSLVQIAGLHVEENDEILPRELEKWMNESTSGVVYFTLGSMVLIETLPTDTLKEIYKSFEKLAPMRVLVKIVNETKLPSGLPKNVKVLPWTPQQPLLAHKNMRVFITHGGLGGLIEALYYGVPMIGIPLFSDQFRNVEAFTAKNMMIQIKLSEINEKNLDNALNRLINDSTFKNNAIYYSNVFRDQPVSPMNNAIFWIEYVIRNGNVLRSPALDFYWWQLALLDIYGPGLIIVLMSLYLVFVGHFYTVL

SEQ ID NO: 8890 - protein, 533 aa, Nilaparvata lugens
MSTLKLSNFFIFFLIVLQSGIEIEGYNILCIFPSISYSHQKPMLAVSEALARKGHNVTAITLNPNKKLNLKNYRQVDANSLYAVWARLQSSVGFSLQQRMTAFEVVKGFVDSSEIMNRAMLYHPAIDGFARELESSNTTYDVVIYEALIYTSLLGMVLQNGKPLPPTIGLLTLSVFSDADWYMGNPFAESYIPTLNVPFNDQMTFYQRLYSLMVILYTWLQVTYKCRPIQEALMKERFGQNLPSIEEIERNRSMLFYLNDFTTGYLRPVQQNTIFVGPINVENQPVEPLPQDLQEWMDGAEEGVIYFSLGSNMKGTSFPAEKRAAFIDAFSRLDKFRVLWKWEDDRLPGQPSNTMIRKWLPQNSILAHPKTKLFISQMGHQSSQEAINFAIPMLGIPIYGDQLQNALKFEKDGISIHMDIEDVDFNANVYKNIQRLLTDNTYKQNMLRLQRLSQDKPMSAADTAVWWVEYVARHKGAPHLRPTVLDLPWYQVYLIDIILFLLAVFAVIILSLYMLLRMLCRCRTKADKKVKVN

SEQ ID NO: 8891 - protein, 412 aa, Haemonchus contortus
MLILLVLCTVVTIISSLNVLVWNPIISHSHVRFLGNIADVLHDSGHNVTIFSPVMDPHANLVGHTKPIFQIPYYSKYLNNSGFDDYDMGSPAFWTSPMVEGRSISIEDIKRYHENALLMCKALIEDHELLDRLRNSRFDVALHELYELSAVAFLELIGVKKAIVVSAAGMTLHMKEITGMPPNPSFVPGIFTTYNDEMTFWERLDNFKCEIELNYRFLQWEEKLRQLFNKASPGFPDLRKLLKQKIGVILVNANEFTETPRPRGNIVRYIGGMAIPEPKPLNQELSAVLDKRSTNVLFSMGSLAKSSTMPLHLKKDILNAFAAFPNTTFVFKYDGKDDLELFKPYPNVHVMKWVPQVDLLGDKRLSLFVTHAGLNSITEATYFGKPMITIPLYADRVHQRQESETNWIGSTD

SEQ ID NO: 8892 - protein, 484 aa, Cydia pomonella
MGRYTPNGAQPNSLNMFRNNLVLLLPSLVHFVHTANILCVFPTPAFSHQSVFSAYTDRLAKAGHNVTVITPLPRRVPHLHEIDCSKSLTVFNELVKKSSLFKVRGVVADESTVTADNYTPLVDMVVAQFQNKNVTDLIENKANMFDLVVCEAYLSLNLIFGHLFDAPVIRISSGHGTTENFDTMGAVHNPLVYPSSWRSTFSTNKTQIMEIEHRLAHEWKKLERVQETRLKQVFGGGSGTSLHSLKKRVVLLLVNVHPVMDNNRPVSSNVQYLGGLHLKRAQSIKDEELRAFIKNDFVVYVSFGSMLDATTMDHRALQEFVRVMNALPYKVLWRVGSSVHQRFSVNGSNILTREWFPQRALLNSGVVKLFVTQGGLQSIDEAVDGGVPMLCIPMVGDQFLNCERVWRLGVGEKLDVVQLEQAKMDRMIVSMVANERYNERVDDLKKLVSDTPVNALRKVLWYTDKVLRNGSLMYVFNGNKYWSK

SEQ ID NO: 8893 - protein, 523 aa, Ailuropoda melanoleuca
MAGQRALLLAGFLLPGFLLSEAAKILTLSLVGGSHHLLLDRVSQILQDHGHNVTMLHQRGNSFISDFTEKEKSYQVISWLPPEDYNKGLKENFDFFIKEALGDRYTFGKFLSFMEQLGLQCSHFLRRKDIMDTLKNENFDLVIVENFDYCPFLVAEKLGKPFVSILSSSFGAIDFGLPNPLSYVPVFHSLLSDHMDFWGRVKNFLMFFDFSIRQRQIQSAYDNTIKEHFPEGSRPVLSHLLKKAELWFVNSDFALEFARPLLPNTVYVGGLMARPVKPVPQEFENFITKFGDSGFVLVALGSMVSNFQAQELLREMNSAFAHLSQGVIWRYKPSHWPEDIRLSANVKIVDWLPQSDLLAHPCIRLFVTHGGMNSIMEAIQHGVPMVGIPLFGDQPENLNHVEAKKFGVSIQLKQINAETLALKMKEVIEDKRYKSAAVAASIIRRSHPLTPAQRLVGWIDHILQTGGAAHLKPRALQQPWHEQYLLDVVLFLLVVTLGTLWLCGKLLGMVARWVCGTRKLKKA

SEQ ID NO: 8894 - protein, 537 aa, Neodiprion lecontei
MMLLFCKSAGMKERLCFTIFLLILSISSEVRGYRILSVLPYNAKSHAIMFEELNKGLANRGHQVDVVGHFPLKKPVENYNDIINLADDSVPKLQNNLTYKFVTSSVLDKPVVPFLTSMFGSELCKLMDHPELKNLIKNPPNDPPYDLLIGEVLAAHCFLALGQHLKVPVVAIVTSPMWPWSSDFVANPDNSAYVPGVFSSLIAPMSFWDRMTNTLDLIGKKMQFYYYTSDQDEFIRKHLGPHALGVREAERNVSLILVNSHYSLNGVRPFTAAVVEVGGIHIPKEIEPLPRDLQEWLDRSKDGFVYVSFGSMLKIESFSGETLRALYKSLGKLAPVRVLMKVAKPDELPVGLPSNVMIRPWIPQLAVLCHKNARVFFTHGGLMSTQEAIHCGVPMIGVPLFSDQPLNVARYIRKNVAVSLVHDELTEEKIDAAFEKVLGDPSYMAAAKKISAEFRDRPMSPLDTGIFWVEYVARHGGSIIRSPAMDLSWFQIALIDVFGTLILGLAVAAYLIKLILKKLFALLVRGTEAPTRYKKIN

SEQ ID NO: 8895 - protein, 524 aa, Neodiprion lecontei
MVARRTIVAAIICILNCAVEFIDCYRILCICPRASISHQVVFRSFTLALNKRGHEIIFVTSDPMNDPTLKNYTEIDISFLYKSNYITVLDVKDWFGSFYKLSGMANLQTDQILQHPEFRKIYTAGSNENFDMVLLEMLYWPALFVLGKRFDAPVIGLSPMGLTMNVQYVLGNPIMTSHPSNWELYSKSPPLTFWDRLGNFVSFWRFLHYYKNNHVTEQAAIARKYFGEDIPDLEELEKNVSLVFANQQTPISFSRPEVRKIVEIAGFHVSPQSKPLPKDIKKILDGATQGFIYMSLGSNMKSSMLSNETRNELVAAFSKLPYEVLWKFENDVLPDKPKNVHILKWTPQQAVLAHPNLKVFVYQGGLQSTEETVSHGVPVVGIPTWGDQRMQIDKMVSLGVGKKLELRTMNRNEIEEAIRTVASNKRYKDEMVKLSTLLKENSQHLLENAIWWTEQVLRHKGTSHLHSITADDPWYRRQDMDLIVFISVGTTVVLILICYVSHKLLTVIISAWKSPSLDRKKKWK

SEQ ID NO: 8896 - protein, 531 aa, Caenorhabditis brenneri
MFCVLTPLVLFSFGNYVDSYNFLIISPVYGFSHMKFLANIANQLAEQGHQVTYFQPFVIEAYQNHNLLKNNSIELINYWHDEEGHKHMPPGNDLHDAWYSGKYQSALAAVLEMPQFFYSAWNHMCRKIFEDTELHVMLKQKDFDVVIGETFDFCGLYLADYIESKSIISVFSGSRLLSITTPLGDPSWLHYLPAPSSETFGPGASIFDRINDLYHKYVFGSGYSIVFDWQYNQVARMTNGKVRNWKKILRDVTFHFSNSNPYLDFSVPTIPKVIPIGGFDMEETVDSSLPEEYEELLNKRPMTVFVSFGSMVKSKFMPDSYKESMLRMFSANSRNITFLWKYEDLKDQFLTNRLPENVILNEWFPQRALLADKRVKLFITHGGLGSTMELAYSAKPAIMIPLIAEQPDNGQMLKRHGSVEVYSKYDIPDWQKLNRLLHKMLNQKSYQKSADRLAHVLSSQPIKPSEMMIKHAEMAAKFGRMPELTPNVQEMGIVEFYNLDIILLLLTFCSIIGYLFLRYMVVNLNLKTKLE

SEQ ID NO: 8897 - protein, 831 aa, Camponotus floridanus
MPFKNLMEAVVQLNLLDLEESIAWTAAHILNRELFKNPEMKKLYAIDSNEHFDAVIVEQGPTQISLNAFAYRFNAPLIGISSLDVFNHMRYTFGSLILPSHISNWQVNTLPESNMSFWRRLVNFYEVWKQMYKWANVHIPIEDAIVKEYLGEDLPHIVDITRNMSIYLVNKHPVLSYDRPEQRNVIFFHGFHIAKVPPALPKDLKQFLDDSTKGFIYVSLGTNVKWEHLPNNTFEFFLEVFSALPYKVVWKYDPDLLPGKFENILASKWFPQQSILAHRNIKLFIYQGGMQSTEETVYYGVPIIGFPIFWDQMYNVQYMTKLGIGVHLHSNNISKESIETAVHEVINNKRYKDRIKYVSKLYNDVPYDSLQNTVRWIEFVIRQNGTLFLRNSLSDETWYQRYDWDIIGFLAILIFIASLLILWTHQIVYRSLCLALNKRGHEIVIVTPRPMKDPTLKNYTEIDVSIVNPTVEEYKNQQSQMSPSELYKYSFDLINIMSDAIFNVPKFKELYKEDSNEKFDAVMVEAIAGLSTCTMAYRFNAPLIGVMSLGIHNHQRYVFGSPILPSHSSNWEVNALLGENPSIWQRLRNFIEVWSLIYYWTSNFITTEQETAKKYLGHDIPQVIDVMKNMSVLLVNENPVNVYPRPEQTNAIFFSGLHIQKTLSRLPKVSHPNIKLFIYQGGLQSTEEAVYYAVPVLGLSVVSEQEIRIKRLVSSGAAIYLPLNKITKECFHTAIHQILNDKSYKEKMTYLSYLFKDQPYDTMENALWWIEFVMRHKEVNILRFSESDNPWYQRYDIDIIALLSVILFMLTCIIVLIIFKILNFILNRIAF

SEQ ID NO: 8898 - protein, 522 aa, Microtus ochrogaster
MAKLQSWLLVSLFLTEVLLLEAGKILTIATLGGSHYLLMNRMSQILQDNGHNVTKLLNKIIYIPEFQKEEISYQVINLDLPEDQQEEFHKKLNLLLEELVRQRNAHGVLVNIYKVFGDLCSHFLGREDIMDSLRNENFDLLLFDYLDFCSYLIAEKLEKKFVTFLPVQFNYMDIVLPSHLSYVPVYGSRLTDQMDFWGRVKNFLMFIDFSLRQREIFSQYDATIQEHFAEGSRPVLSDLLPKAELWFVNSDFAFEFARPLFPNTVYVGGLMDKPARPIPQDLEDFISKFGDSGFVLVALGSVATMYQTKEFIKEMNSAFARLPQGVLWTVNDAHWPKDVRLAPNVKIMDWIPQNDLLAHPSIRVFVTHGGMNSIMEAIQHGVPIVGIPFCSDQPDNLVRIEAKKIGVSVQLETIKAETFALTLKEVIEDKRYKSAAMTARAIRRSHPLTPSQRLVGWIDHILQTGGGAHLKPHGFQQPWHVQHLLDVLLFLLGLTLATLWLLKKVLGLLLRPLCVARKEKKA

SEQ ID NO: 8899 - protein, 525 aa, Neodiprion lecontei
MRRVSVFLALLLCNVYFTRHVNGARILAIFPLEIPHQFFFFQEILWTLVEQGHKLDVISHYPLIRPHPNYENIIHLTGKGPRFTFNLTADTLDSLANKPVEYYAEQYGNKACELLALPEFKKLIEEPQTNPPYDLVITELLYANCYFAFGRHFKVPVVAVSMSALPPYISEPLGNPVNTAFVSEHIDGSILHMNFWQRFKNTLHTWWTNYRIRRVTEAQNSIVKTHFGPDMPDIRELERDLSLLLVNSHHSLNGVRPFTPAIVEIGGLHVRDDGTELPEELKAWLDSSADGFIFVSFGSLLAIENFPKDIIAELYSALAKIAPIRVLLKGAAPEALPPGIPTNVLALEVVSQRQVLKHGNIRAFVMQGGSLEIHEAVMFAVPFIGLPIFPEPQRNVKNCVEKGVAISMDFGDFTADKFTAAVSEIVSDAKYKNNIITLGRKFLDRPRSPLETAIFWIEYILRNGGDSLRSPAVKFSWWQLALLDIYAGITVAVIVVIYICKRLTLTVIRRLFRPHPTLPTSKKMV

SEQ ID NO: 8900 - protein, 425 aa, Diabrotica virgifera
MRAPFWGRSAHDKDVDTALNEICRIVTRCMKPTPLSNLYKAAGFAEPSTRRGVAEHIEKINRLLSGISSLGLFLHSHDALGNPTHPIVSPDMMLNFSGKLSFFDKVQSFLYNIWYRMFYYWYALPKADKIARKYFGDDMPYLGDLEKNISLLLLNVNPIIHNVRPNVPNVIEINQMHIKKRKPLPKDIQDYLDSAPQGVVYFSLGSNVKSANLTEQIRKEIVAGLGALPYKVLWKWETDYLPNKPDNVMTKKWCPQQDILAHPNIKVFVMQGGLQSIEEAITLEVPLVGMPFVTDQPSNIKRIVELGLGVKVDHKTLTRDILKDAIMEVAQNPKYKEEVKKAKSILLDQPMKGVEKAVWWIEYVIRHKGARHLRSPAADMTLLEYFMVDVVLFLLTCVVVALYSVYKLLSVLRAMLRSSQKIKKQ

SEQ ID NO: 8901 - protein, 525 aa, Trichogramma pretiosum
MARSWIVALLLLAASLSSSHGLRILGIFPLQGKSHFIMGEALMRGLAAKGHRVDVYSHFPLKKPIPNYTDYSLAGTLPALANNMSFNYMNSITGVGSMSKDMELIGNPVCELLNLPIFQNLIKNPPNDPPYDLIIIEMFLSNCYLALGPHLNVPMVSMVTTSLFEWMYRPLGNPSRLAVEPTMYSGAHHPMSFKDRVRNVLLSHYSECSFNAEARKSQNAVVERAFGPGTTDVIDLQKEISLTLVNYHHALNGVRAFTPSVVPVGGIHIFENEDNALPVKIKKFMDESKDGFVYVSFGSMVQLETFPEHDLKELYASFKNIAPIRVVMKIAKPELLPSGLPSNVVTHSWLPQVQVLKHKNIKAFVTHGGLMGTQESIYYGVPLIGFPLFGDQHFNIDSYTKKNLAIRLDRYNIKEETLTAAIKEIINNPQYKNSADKASKAFRDAPLSPLNTAIYWVEYIAKHGKYSLRSPIVNLPWWQASLLDVYAFLATIFMLLVVTLYKLVAILLKLIFKFQKSKPRKMKKK

SEQ ID NO: 8902 - protein, 511 aa, Bicyclus anynana
MKLATLLLAVASLTTTSAYHILCVQNVPSKSHYHLMKGLVDPLLEAGHQVTLITTFPGSKPVPNLTYIDVSHIQDLVKHIDMTHQQSQGLDIVKQFARNISRSSLETPAVRDTLTRGQFDAVITEWFFSDMDAGYAAVLQVPWIQLSGMVLHTHMEYLVDAVRSVPTIPAMVNDYDVPMTLWQRLMNSFAYLYFSYHTTWDQSSVQANYEQYFAPIAAARGVALPEFTSAMRNISVLFVNSHPSFAPAMPVPPNVVDIAGYHIDEVVPPLPKDLKDLLDSSPQGVVYFSMGSVLKSAALPEQTRKDLVKMFSELPYTVLWKFEEKMEGLPKNLHIRPWMPQSSILSHPNVKVFITHGGLLSTLESLQFGVPVIAVPVFGDQPSNARRSVRAGHALMVPFHPPDMAADLKVALHETLSNSSYYKRAQQLSKLFRNRPVSNKKLIQHYVELAIETKGAYHLRSKSLLYSWYQLWMLDQLAVLVLALLLIITLIKRGINRFTKKPVKGKKDKRN

SEQ ID NO: 8903 - protein, 533 aa, Laodelphax striatellus
MNMMKLLNFFVFVLVVLQSGFEKCKGYNILCIFPSVSYSHQKPMLAVSEALARKGHNVTAITLNPNKKMNLKNYRQIDANSLYGIWAKLHSDVGFSLQKRMTAFEVVKGFAASTEHFNRALLYHPAIDGFAREIEATNATYDVVIYEAIIYTSLIGMVLQNGAPLPPTIGLLTLSVFSDADWYMGNPLAEAYIPTLNTPFTDHMTFYQRLYSLAIILYTWYELSYRSRPIQEALMKERYGAGLPSIEEIERNRSMLFYLNDFTTSYLRPVQQNTVFVGPINVENQPVDALPQDLQKWMDEAEEGVIYFSLGSNMKGTSFPAEKRAAFIEAFSRLDKIRVLWKWEDEKLPNQPNNTLIRKWFPQNSILAHPKTKLFISQMGHQSSQEAINFAVPMLGIPIYGDQQQNAQKLEREGVSLFLDIVDDNFNSDVYKNIQRILSDNTFKQNMIRLQWLSRDKPMSAADTAVWWVEYVARHKGAAHLRPAVLDLPWYQVYLVDIFLFFTIIFSVMILFLYMLLKILFCRSNISKKVKVN

SEQ ID NO: 8904 - protein, 526 aa, Jaculus jaculus
MAGPRSLLLVSFFLGGPLFSLAAKILTISTLGGSHHLQMQKISQILQEHGHWVTNLLYNKDLTSGIIKNINMKEVSYRVIPWSVPEEQQEKFNDILDFLYQKAVDGRSSINDYIRLFEHFGNSCRHLLSRRDLMDSLRNENFDLLVFDSADLCSFLVAEKLEKPFVVFIPVMFSYVDYGLPSSLSYVPVAGSLLTENMDFWGRLRNFLTYLVYSMNQRLFHSQFDNTIQEHFAEGSRPVLSHLLRKAELWFVNSDFGFDFARPLLPNTIYVGGLMDKPVNPLSQELEDFIAKFGDSGFVLIAQGTILSMYQTKKHIEEMNKAFSDIPQGVIWKFNCSQWPEDVKLPANVKMMDWVPQNDLLAHPRIRLFVTHGGINSIMEAMQHGVPIVGIPVTADQPENMLRVEEKKFGVSVHLQNLRAETLALKMKEVIEDERYKSAAMAARAIMRSQPLTPAQRLVGWIDHILRTGGAAHLKPYAFQQPWHEEYLLDVLLFLLGLILGTLWLCWKLLGFATRWLRGARKLKKT

SEQ ID NO: 8905 - protein, 520 aa, Peromyscus maniculatus
MAEHRIGILVSLFLLDVLLLDAAKILTLSTAGGSHFMVMSRVSQILQDHGHNVTNLLNEKLIILDFKEKISYEVINWHLSEDELKETDNRRQLLCEDIVHRSNHHTNIKMFEYFADLCSHLLSRNDIMDSLRNKKFDLLFLDVTDPCVFLIAEKLGKQFVAFLPSLFSIIDYGLPNPLSFVPGFGSILNDQMDFWARVKNFLMFLDSSMKKREIFSQYDSTIQQHFAEGFRPVLSDLPRKAELWFVSSDFALDFPHPVLPNTIYVGGLMDKPVRPIPQDLEDFIIKFGDSGFVLVALGSLATQYQTKELIKEMNSAFARLSQGVLWACKDALWPQDVRMAPNVKIMDWLPQTDLLAHPRIRLFVTHGGTNSLMEAIQHGVPMVGIPFFLDQPKNMVLVEAKKIGVSVQLETLKAETFALTLKEVIEDKRFKSAAMAARAIRRSHPLTPSQHLVGWIDHILQTGGGAHLKPHGFQQPWHVQNLLDVLLFLLGLTLGTLWLLKKMLGLLLRSQGVVRKEKKS

SEQ ID NO: 8906 - protein, 481 aa, Neodiprion lecontei
  MOD_RES (336)..(336): Any amino acid
MDLANRGHQIDVVSHFPLMYPFHNYRDIVDLNGKMDVMANTMTFETVEHVGNVALEEYGAQKVGNDLCDILGIPEIQELINNPPKDPPYDLVIAEFFFANCFFAFGRHLNVPVVAMTSAPTLHYSNEPLGNPLNPAIVPEYEDGSIIHMNFWQRLRNTLYTFNRIRRIRSLTEVQNDAVKKYFGSDMPGVRELERDVALLLVNSHHSLNGIRPMTPAILEVGGIHIRFENVELPADLRNWLDNSTSGFIYACFGTLLRIESFPKEFLAELYSGFTKIAPIRVLLKSTNPEELPPGLPQNVMTMKWLPQAEVLRHKNIRGFVTHGGLGGIQEATAFXVPFVGIPIFADQPRNVKNCVEKGVAVSLNYKDFTADKFVSAVNDIIHDPKYKNNMMILSKKFMDRPLNPRDAAIYWIEYIITYGGDSLRSPAVRLTWWQLALLDVYGSILVAALVTIYLVKLFISALIRRIVRSKETVPLTKKKN

SEQ ID NO: 8907 - protein, 523 aa, Jaculus jaculus
MAGPRALLLVSFFLGGPFFSLAAKILTISTLGGSHYLQMQKISQILQEHGHWVTNLLYNKDFVKPDAQKKEVSYQVIPWSVPEEQQKKFNDFRDFLYQKAVDGRSTFNDYLMLYEHLGILCSHLLSRRDIMDSLRNENFDLFVFDSIDLCSFLVAEKLEKPFVVFLSVTFMYVDFGLPNPLSYVPVTGSFVTENMDFWGRVRNVLMYFVFSMKQRLIHSQFDNAIREHFAEGSRPVLSHLLRKAELWFVNSDFGFDFARPLLPNTIYIGGLMDKPVNPLSQDLEDFIAKFGDSGFVLIAQGSILSMYQTKKHIEEMNKAFSNLPQGVIWKFNCSQWPEDVKLPANVKMMDWVPQNDLLAHPRIRLFVTHGGINSIMESMHHGVPIVGIPVTADQPENMLRVEAKKFGVSVHLQNLRAETLALKMKEVIEDERYKSAAMAARAIMRSHPLTPAQRLVGWIDHILQTGGAVHLKPYAFQQPWHEQYLLDVLLFLLGLILGTLWLCWKLLGFATRWLCGARKLKKT

SEQ ID NO: 8908 - protein, 526 aa, Athalia rosae
MRGSWCFLILILNFLALFCNGYRILGVFPFNGKSHFVMFERLMKGLAVRGHRVDVVGHFPLKKPFPNYNDIVSLDGTLPNLVNNVTLDFVEKIRNVYSPATTISTVFGTELCHLMDHPRFKNLIQNPPGDPPYDLAVVEIFGANCYLALGHHFGVPVVGIVTGLMFPWINKLVGNPDNTAYVPNSFSSFTGSMNFWERVENTASHFAMNWKFDRGASRQDDLIKKYIGPDALSVEEARKNISLVLVGSHYTLNGPKPLASSVIEVGGLHIEENESTLPDDLKNWLDGSDEGFVYVSFGSMVKIESFSEETIAALYASLRKLSPIRALVKIAEPEQLLPGLPSNVMTSPWIPQVAVLKHKNIRAFVTHGGLMGTQEAVYAGVPMIGIPLFGDQDQNVRLYVKLKLAVNLNLYEITEENLDAAFDAVLRDPTYKKSAKIMSKKFRDRPTSALETAIFWIEHVVRDGGSALKSPAIHLTWWQISLLDVYAFFILLIAVIGSITLAAVLKLKKLFRHQGIKIALTRKKVT

SEQ ID NO: 8909 - protein, 408 aa, Caenorhabditis brenneri
MFEDTDLHYDLKSRQYDVVMSEAFDFCGLYLASYLEMPSIISTFTGNRLNALAPVLGEPSFLHYLPAPTSQYGQKSTIWDRANDVWHKIFSSYGFAQLFELQYEQVKKLTNGKVKHWKEIIHDVTYHFSNSNPYLDFVIPTIPKVVPIGGITVDQNSWDVKDNHSEELERLLDERKHTVFISFGSMVRSVDMPSEYKDSMIKVFNDHPNITFLWKYEVPNDQELLKKLPRNVHLAKWFSQNALLSDRRVDLFITHGGLGSTMELANAAKPAIVIPLFADQPGNAKMIERHQSVEVYSKLDIRNWKKLSNLLRKMLNTEVYQEHANRLADTLRFQPISPADLMVKHAENAARFGRMPNLVPYAKDMGIVEFYNIDLILILGLISTLVVFIISIICTKLKGLLTFKLKVE

SEQ ID NO: 8910 - protein, 990 aa, Caenorhabditis briggsae
MWLFGSIVQIALLYNLVLPTANGELADEFEHYRECLEKVEKDVGEERKIKVVHAVRGADVILPCFTCVSPEDGVEIDSTYKPSAGSVGRSLNYIVDFFKEKFLRSSFSMPDENRWKFDWEFAMMGRMFVPLSSMHFDASESISDRIHRFTSKDEAEFKLGDRYELVLKNVDGNSTGHYRCMNRHGRNVISNMYFLEVSNEKNIIPLNGTIGVEKLPSVALKSGKLEKLNLKYSVKATDWSKCSYCSSDRGEQTRSIKCYVEPSTKTTSQKLELRYLLLYDKIPCTSTLVPLPVRKELKKMGNDKIFLETRPCFEECTGAEELNRIVNSSQDLGDIRTLDYLPGGEFVFGNVLPRLLPPVVRRVQLVLSNDPQVLSCQKLIDLNTGVHWYSLKNGPIQHSTIHEMYQERAYFDEDTNLVFRQFTMEDDDEYFCYSSNNILLGTFHMRVVESDQHHQVIEVVMHVPLLFLLLLFATSSTTSCFKILVSVPKFGYSHMNTMGKLADILVESGHDVTFLMPVDVPIPQNGTELAKVVLVPPTDEISKIMEASMKDGAVANLWTHSANSKQGIMWSTDMIGIVSYHNTKNMISNKALVQQMKDEKFDIGITELFDFSGLSFFEVIGLKNVIGAHTTSVFEGTLMATGAPILPSFVPASQTFTDDSGSILSRLNNLYMTYWSYEFQNKIQGFAQKALNEHYGKGKAPKIWDLVKDITWFFVNSDPIFDFPKPLPLNIIEIAGISVSKIHPLDKEWDEILSKRSKNVLVSFGSIASPTTMPEAVKKSIVDTFAAFPDVTFIWKYDDTESGITSHLNNVHIVKWMPQNDLLADKRVSMFWTHGGMGSLMESAQKGVPLVVVPIFGDQMRNAQIAKRHGVAVIYDKMELSNTKKLIGTLKEVLENPEYKKSADLLAQILAYERVSPKQKIVDTIELAGRFGQLPRWTSSGKQFSLLKYFNLDLVLFAIFLVFGILVSFVLLVRLILVKLGFSGNKEKSE

SEQ ID NO: 8911 - protein, 520 aa, Musca domestica
MDIRSILLIALFMSFAIFKSVEGAKILSIFPYSGPSQYIFISPLLKALAEKGHEVTSISTFPQKKPLKNFRDVVVMENSNIFDEMFTQATAGEAEGKSFFEEFAELSSLGVTASSNVMENVDVKKLLKNEKFDLIIIEVFGTESLFGLGEYFQAAMIGVSTFELTANPSPASYIPHMSLEYDSHMSLWQRTVNILTNVVDNLCTNFFLIAGQEKVYKKYFPNAKLSLDEARRNVSLVLLNDHFSLQAPRPYVPNMIEVGGLHIKQKPDPLEEDLQKFLDDSPEGVIYFSMGSNAKSKDLAPHTLQAILSTFAELKIKVLWKFELEELPNKPANVVIRKWFNQPSILAHPNVKLFISHGGYLSTTETIFHGKPILGIPVLGDQFMNVKNAVKAGFALRLDLRSLTKEKFMQSIQELWTNPRYTNAVKTLSKRYRDQPLTPMETAIFWVEYVLRHDGAPHIRNAGQDLSYWQYHNIDVYLLLASCIVVVFTLIASLIRFGKKIICAASKSMKKSKKSKIKKN

SEQ ID NO: 8912 - protein, 1063 aa, Camponotus floridanus
MWSKIYLFSIYTILYGIVQYNVTHAKRILVITNFPSYSHQIVYRNLCLELNKQGHEIVSVTTDPIKNSSLTNYREIDLKYFYKGFLEYKKMPFKNLMEAVVQLNLLDLEESIAWTAAHILNRELFKNPEMKKLYAIDSNEHFDAVIVEQGPTQISLNAFAYRFNAPLIGISSLDVFNHMRYTFGSLILPSHISNWQINTLPESNMSFWRRLVNFYEVWKQMYKWANVHIPIEDAIVKEYLGEDLPHIVDITRNMSIYLVNKHPVLSYDRPEQRNVIFFHGFHIAKVPPALPKDLKQFLDDSTKGFIYVSLGTNVKWEHLPNNTFEFFLEVFSALPYKVVWKYDPDLLPGKFENILASKWFPQQSILAHRNIKLFIYQGGMQSTEETVYYGVPIIGFPIFWDQMYNVQYMTKLGIGVHLHSNNISKESIETAVHEVINNKRYKDRIKYVSKLYNDVPYDSLQNTVRWIEFVIRQNGTLFLRNSLSDETWYQRYDWDIIGFLAILIFIASLLILWTLFQILRFHLRMLSNSLRQYESALIRALNSDKMYKVICRICVILSLWLLLTNNIANAERILVITFAPFYSHQIVYRSLCLALNKRGHEIVIVTPRPMKDPTLKNYTEIDVSIVNPTVEEYKNQQSQMSPSELYKYSFDLINIMSDAIFNVPKFKELYKEDSNEKFDAVMVEAIAGLSTCTMAYRFNAPLIGVMSLGIHNHQRYVFGSPILPSHSSNWEVNALLGENPSIWQRLRNFIEVWSLIYYWTSNFITTEQETAKKYLGHDIPQVIDVMKNMSVLLVNENPVNVYPRPEQTNAIFFSGLHIQKTLSRLPKDLEQFLNNATEGFIYVSFGTTIVCRSLQNEMLENFIEVFSKLPYKIVWKFDCDKLSKKSDNVFISSWFPQQSVLAHPNIKLFIYQGGLQSTEEAVYYAVPVLGLSVVSEQEIRIKRLVSSGAAIYLPLNKITKECFHTAIHQILNDKSYKEKMTYLSYLFKDQPYDTMENALWWIEFVMRHKEVNILRFSESDNPWYQRYDIDIIALLSVILFMLTCIIVLIIFKILNFILNRIAF

SEQ ID NO: 8913 - protein, 396 aa, Fopius arisanus
MELKCLVLIINFLVINSVMESESHRILAIFPFQSRSHQMMFDALVKGLVNKGHLVDVATVYPLKKPPKNYTVVVNLEGKQESLVNKWNVEFASKLGQDTLPIIALPFGNGLCEYLALPEMQEIIKNPPQDPPYDLLMVESFGANCFIGLGHVLNVPVIMVSSTIPLPWLETSLGQPQYPAFVPAFFTNLQHPMSFLERVINTVKTYSNNLRYDYYTETVQNEQMRKYIHPDTPPLRQLEKDVVLALVNSWHSLNGIQPVTPGVIAVAGLHVEANYVPLSKELEKWLNDSTSGVIYFTLGSMVNIETFPDETMRAIYSVFRGIAPVRVLMKVANKTALLPGLPDNVMTSSWIPQVAVLAHKNTRVFITHGGLMSTQEALTYGVPLIGIPLFGDQHNN

SEQ ID NO: 8914 - protein, 430 aa, Diploscapter pachys
MNPQLSMSIFNTTAARRYIIVEALSTNATEEFIKQERYDIGLTTDYEFCGHVILFKNGLSSIASYSAMPIIPETIFAAGLPSPASSFTPFQPPVNPYSIWSRFMNAIRLGEAYYIDMKWITDEFTKIAREKYGPDFPDVEQLIYKLDVIFVNSNQVFEPARPISHKTKYIGGIALKQPKPLNEDMNEMLSKAKRGNVIVAFGSQILTKAMPFELRRHFVRAFNKFPEFSFIWRYDEMEDDDVLFENSTNIHRIKWLPQIDLLNDERVVGFVTHAGLNSILEASFAGIPMIAIPIFADQPYNALSGKQRGTTFIIDKVNVNEDTLAEGLSAILYDESYMENAKRISKLMKENPEQGKDVFINWVEYAANNKELYKINSLPGSDLTPFTYYLIDVTILCTIASLLVLYLVLKTILFIYKFVSLKMSQKVKVN

SEQ ID NO: 8915 - protein, 513 aa, Helicoverpa armigera
MKITLVLLLLCLTNSLAYKILCIFPAASKSHDHLSKGVVDALLKAGHEVTWATPFEKKNVPKNLRIIDLTATRAIVEGVDATDTENHSISFVRNFTTVMSRTASENPTLRKVLIEQQFDAVMTTWAFNDFDAGYAAIQQVPWILLSSVGVHPYLESIVDVVRSIPTTPMIIADGEVPMTWQRRWLNGLIYMLMTVDSWFDIPRQAALYESMYAPIAAARGVPLPPFLEAKHNVSILLVNSRESIGTAYSLAPNVVNIAGYHIDENPAPLPKDLQDLMDNSPQGVIYFSMGSIVRSTAMKPHTRDALIKIFSKLPYTVLWKFEEPLDNLPPNLHMRPWMPQTSILAHKNLRLFITHGGLLSTLEAIHVGVPLLAVPVFGDQPGNAERAQRTGYAVRVNYHENMAPELEVALNEMLSNDSYTKKVKHLSKLFRARPISPSKLISFYVELAIETKGAYHLRSLALQYSWHERWMFDFVLAVLGVLAALAWLVKLAVTACVRRFSGKKQSANKKKKN

SEQ ID NO: 8916 - protein, 508 aa, Strongyloides ratti
MINIADFLAENGHNVTIIHAPMNPKTIDNQGKKATVVRPSTYDKKIKDIFDIADKNLKEIWNIDSLWNPYYTLTFISIYNKWLAASCEHIIKEDNLTELIRNEKFDLGIGEAFVPCVFGMFKYYNITKHVAVMSGIPYDTHYNEMGINFPIGQVPSIFAPISENMSFMERLYNTFFYLTSKYLHREGVYLGNDIFNKHAPTYNINLENIFNECIFYISNTDPIINYGVPGSPKMIQLGGFLLKQPSPLNSYFDNLLNKRKKNVIISFGSFAKSINMPKEGLNTLIELFKSFPNVTFIFKYEEENSLFLKNFDNVITTKWLPQYNLLNDKRVSVFIMHGGMNSLLESSRAGVPMLGIPLFYDQPRNAKIIGELKLGRWIDKFQFIKDKNLFINTFRDVLENPLYKKSIKKISEMIRKKPYNEKELFLKYIEFACQFGEIRNFNIGSKKKLLYQYSMIDIYLFIIFSFYGSIYWVYLFLKYIWFFLVHIYYSMYNKYESYKKNKSKEKKQ

SEQ ID NO: 8917 - protein, 518 aa, Ochotona princeps
MLLLGCFLLSGALFSDAAKILTVATLGGSHYLLVARVSQILQDHGHNVTMLHQGGNSLMAGFKEEEKSYKVTSWIPPQDHQKEFNKCFDNFMEEALHGRGTFENLLKLMEQLGFQCSHLLRRRDILESLRSENFDLIVVEIFDYCPLLLAEKLGKPFVSLLASSFGALDFGLPSPLSYVPVFSSLLTDHMNFWGRVKNFLTFFGFSMKQRKLQSMFDNSIKEHFREGSRPILSHLLEKAELWFVNSDFAFEFARPLNPNTVYVGGLMVKPIKPIPQDLENFIAKFGDSGFILVALGSMVSTYETQEILKEMNSAFAQLSQGVIWKCKHSHWNKDVKWAPNVKVMDWLPQSDLLAHPSIRLFVTHGGQNSIMEAIQHGVPMVGIPLFGDQPENIVRIEAKKLGVSIQLHNLKAETLALMMKQVIEDKRYKAAAVAASVIRHSHPLTASQRLVGWIDHILQTRGAAHLKPYASQQQWHEHYLLDVCLFLLGSTLGSAWLAGKLLSMVAKWLRGAKKLKEM

SEQ ID NO: 8918 - protein, 512 aa, Heliothis virescens
MKATLAVFLLCLSSTLAYKILCIFPAATKSHDHLSKGVVQALLKAGHEVTWATPFEKKNVEKNLTIIDLTATRKIVDGMDMTDTKTQSISQIKNFTTVMSKTASETPALRKVLVEQQFDAVITTWAVNDFDAGYAAIQQVPWILLSSIGIHPYLENLVDEVRSISTTPLIFNDGEVPMSWGRRWINGLVYMLMCVDGWFDNRRQAALYESMYAPIAAARGVPLPPFHEAKHNVSILLVNSHESIGWTYSVPSNVVNIAGYHIDENPPALPKDLQDLLDGSPQGVIYFSMGSIVRSTAMKPHTRDALIKIFSKLPYTVLWKFEEPLSNLPSNVHVRPWMPQASILAHKNIRLFITHGGLLSTLEAIHAGVPLLAVPVFADQPGNAERAQRAGYALRVDYHEDMAPKLEVALNEMLSNDTYTKKVKYLSKLFRARPVSPSKLISFYVELAIETKGAYHLRSLSLQYSWYERWMLDFVLALLGVLAALAWLVTLAVRACVRRLSGKKQGADKKRN

SEQ ID NO: 8919 - protein, 500 aa, Apis mellifera
MKLSSIVFLCAILSACYGYRILGVFPFNGKSHFMMFERLMKILAKKGHQVDVISTFPLKKPYPNYTDLIALPVSSSWINNLTFHEIQNSFLVSAPFVVGHMAGNMICEFLKHPKVQELIHNPPKDPPYDAIILEVFGAHCFGIIADILKVPMIGVSSSVLYPWSYDYIACPHNLAYAPHNLLFYSQNMNFWQRMYNFLDNLYSIWAFNRVTVPQTEIMRKYVKPDAPDIRDLERNMSIILVNSHISTNGIKNLNPALIEVGGLHVHDDETVLLPPSLEKWMNESEQGFIYFSFGSMVMIESFPIETLRIFYNSMRKIAPVRVLMKIANSDKLPPGLPENVYILPWIPQVKVFKHPNIKAFITHGGLMGSQEAIHYEVPMIVKLKIVSLTQEEMDHALNEILNNPKYKKAIKELSKKFLDRPMSSADTAIYWIEYIIKYGSTVLRSPAMDLTWWQLELLDVCGFLLIVTLVVLYLLALGLQFVYHRLVNSSFVVPQKKKIS

SEQ ID NO: 8920 - protein, 568 aa, Toxocara canis
MYFSDLLLIFPLRAEHSQQIVKESFSLLSRSEHFSNAKRMIVRLIVIAWSLLFVSHGLKILVYQTALSRSHLMYSGGLVDILVDARHEVHKLIANWNPTISDNGTKKATSVYRFTLSKPSPWLKINHFSEPFEAKVINYHMDSREAALHWQTIAEFCKEMLADEKLLHWLQNSNFDIAISTTYDFCVFGLFHVAKIKPVIGFLVTPISDIVLYALGISNPASYTQDSFYPSDNGDQMTYLQRVNNLYTRTLMQQIYIPRFIAMQDEIFHGKFGKRMPSLQTLFSQMSYIFVNAHPLVDYPRPLSHKLIFIGGIQLNDAGQLPQEFDRVLSMRPDGAVLVSFGSTALTSKMPKNLKRIFLEVFAAFPQLTFFWKFDEPHDKSSFTNISNVYMAKWLPQKQLLGDKRMKAFITHVGLNSLMESIHEGVPLVGIPLFADQLHNAGIIRKRQIGIVIDKRNITVENLRNSLNDVLYNDRYRQTAKMLSAMIRKNPNNPTKTFLKYVEFTAQFPNVGEYLQLQSTNLSSVEYFCIDIIVPFIFIAITLLYFCFKALLIILAKCMQREAKDKFE

SEQ ID NO: 8921 - protein, 526 aa, Nasonia vitripennis
MKFIQTICLLLSVINLGSVCRAYRILGVFPFNAKSHNIVFEALMKGLAKRGHQVDVVTHFPLKNPVKNYNEIINLDGSLENLVNNFTIEFVSKITGDIVDLIATSYGNRVCQIMGFESMQKLIKNPPTNPPYDLVITEAFGANCYMGLGYVFKVPVVAVSSAVEYPWISHFIGNDDNPAYVPNAYYVSTGKMNFWNRLKNAVINLIETRKFHVLTEDSQTESMRKYLSPDIPNIRQVEKNVALTLVNSHPVLFGVKPITPALVQIGGLHIEGNDEILPTELKKWMDDSKHGVVYFTLGSMVLIETLPEAQIKEIYASFRKISLVRVLMKIADASKLPPGLPDNVKVLPWIAQQPVLAHPNTKVFITHGGLGGLQEALYFGVPMIGIPLFSDQFRNVAAFVAKQMMIKIDFNQFSGELLDSSLQALLHNSVYKKKSMYYSRLFRSQPISPMNNAIYWIEYVIQNGDDSIRSPALQFFWWQLARLDVFGFIFLVIISSMSVIIIGIRYAVIKAFRMSQIRVPDKKKIR

SEQ ID NO: 8922 - protein, 1068 aa, Zea mays
MAGNEWINGYLEAILDSHTSSRGAGGGGGGGDPRSPTKAASPRGAHMNFNPSHYFVEEVVKGVDESDLHRTWIKVVATRNARERSTRLENMCWRIWHLARKKKQLELEGIQRISARRKEQEQVRREATEDLAEDLSEGEKGDTIGELAPVETTKKKFQRNFSDLTVWSDDNKEKKLYIVLISVHGLVRGENMELGRDSDTGGQVKYVVELARAMSMMPGVYRVDLFTRQVSSPDVDWSYGEPTEMLCAGSNDGEGMGESGGAYIVRIPCGPRDKYLKKEALWPYLQEFVDGALAHILNMSKALGEQVGNGRPVLPYVIHGHYADAGDVAALLSGALNVPMVLTGHSLGRNKLEQLLKQGRMSKEEIDSTYKIMRRIEGEELALDASELVITSTRQEIDEQWGLYDGFDVKLEKVLRARARRGVSCHGRYMPRMVVIPPGMDFSNVVVHEDIDGDGDVKDDIVGLEGASPKSMPPIWAEVMRFLTNPHKPMILALSRPDPKKNITTLVKAFGECRPLRELANLTLIMGNRDDIDDMSAGNASVLTTVLKLIDKYDLYGSVAFPKHHNQADVPEIYRLAAKMKGVFINPALVEPFGLTLIEAAAHGLPIVATKNGGPVDITNALNNGLLVDPHDQNAIADALLKLVADKNLWQECRRNGLRNIHLYSWPEHCRTYLTRVAGCRLRNPRWLKDTPADAGADEEEFLEDSMDAQDLSLRLSIDGEKSSLNTNDPLWFDPQDQVQKIMNNIKQSSALPPSMSSVAAEGTGSTMNKYPLLRRRRRLFVIAVDCYQDDGRASKKMLQVIQEVFRAVRSDSQMFKISGFTLSTAMPLSETLQLLQLGKIPATDFDALICGSGSEVYYPGTANCMDAEGKLRPDQDYLMHISHRWSHDGARQTIAKLMGAQDGSGDAVEQDVASSNAHCVAFLIKDPQKVKTVDEMRERLRMRGLRCHIMYCRNSTRLQVVPLLASRSQALRYLSVRWGVSVGNMYLITGEHGDTDLEEMLSGLHKTVIVRGVTEKGSEALVRSPGSYKRDDVVPSETPLAAYTTGELKADEIMRALKQVSKTSSGM

SEQ ID NO: 8923 - protein, 1043 aa, Arabidopsis thaliana
MAGNDWVNSYLEAILDVGQGLDDARSSPSLLLRERGRFTPSRYFVEEVITGYDETDLHRSWVKAVATRSPQERNTRLENMCWRIWNLARQKKQHEEKEAQRLAKRRLEREKGRREATADMSEEFSEGEKGDIISDISTHGESTKPRLPRINSAESMELWASQQKGNKLYLVLISLHGLIRGENMELGRDSDTGGQVKYVVELARALGSMPGVYRVDLLTRQVSSPDVDYSYGEPTEMLTPRDSEDFSDEMGESSGAYIVRIPFGPKDKYIPKELLWPHIPEFVDGAMSHIMQMSNVLGEQVGVGKPIWPSAIHGHYADAGDATALLSGALNVPMLLTGHSLGRDKLEQLLRQGRLSKEEINSTYKIMRRIEGEELSLDVSEMVITSTRQEIDEQWRLYDGFDPILERKLRARIKRNVSCYGRFMPRMVKIPPGMEFNHIVPHGGDMEDTDGNEEHPTSPDPPIWAEIMRFFSNSRKPMILALARPDPKKNITTLVKAFGECRPLRELANLALIMGNRDGIDEMSSTSSSVLLSVLKLIDKYDLYGQVAYPKHHKQSDVPDIYRLAAKSKGVFINPAIIEPFGLTLIEAAAHGLPMVATKNGGPVDIHRVLDNGLLVDPHDQQSISEALLKLVADKHLWAKCRQNGLKNIHQFSWPEHCKTYLSRITSFKPRHPQWQSDDGGDNSEPESPSDSLRDIQDISLNLKFSFDGSGNDNYMNQEGSSMDRKSKIEAAVQNWSKGKDSRKMGSLERSEVNSGKFPAVRRRKFIVVIALDFDGEEDTLEATKRILDAVEKERAEGSVGFILSTSLTISEVQSFLVSGGLNPNDFDAFICNSGSDLHYTSLNNEDGPFVVDFYYHSHIEYRWGGEGLRKTLIRWASSLNEKKADNDEQIVTLAEHLSTDYCYTFTVKKPAAVPPVRELRKLLRIQALRCHVVYSQNGTRINVIPVLASRIQALRYLFVRWGIDMAKMAVFVGESGDTDYEGLLGGLHKSVVLKGVSCSACLHANRSYPLTDVISFESNNVVHASPDSDVRDALKKLELLKD

SEQ ID NO: 8924 - protein, 805 aa, Nostoc punctiforme
MYELVQAVFNGDEKTALHQLIYTLSASGKRYLLRNEILQAFADYCHESQKPAYFYHSSSIGKLIQYTHEIIIEEESTWFVIRPKIANQEVWRLTANLDSFEQMTQQALLDVRDRLVNRYQPGILEIDLHPFYEDSPRIDDPRNIGQGLAYLNRYLCNQLLTDPEYWVEMLFQALQGLQHDGIRLLLSDRIPSGIHLAKQIKLALKLVNERSPHEPYEKFSLDLQELGFEPGWGNTAARVSETLELLDRLIYSPEPGILEAFVARVPAVFRVVLISIHGWVGQEDVVGRDETLSQVIYVLEQARSLENELREQIKLAGLDQLGIKPHVIILTRLIPNCEGTFCYLPLEKVQDTENAWILRVPFGEFNPEITNNWISKFEIWPYLEQFAIDAEKELLTQFKGKPNLLVGNYSDGNLVASLLSRRMKVTQCNIAHSLEKPKYLFSNLYWQDLENQYHFSAQFTADLISMNAADFIITSSYQEIVGTPDTIGQYESYKCFTMPQLYHVVDGIDLFSPKFNLVPPGVNESIFFPYSQKENRDSNLCTEIHNLLFSREDPQILGHLDRPNKRPIFSVSSISSIKNLAGLAECFGQSQRLQEHCNLILLSSKLHPDEATNPEEAEEIQKLHNIIDRYHLHSKIRWLGMRIPSSSLGEAYRVVADCQGISVHFARFESFGRSILEAMISGLPTFATQFGGSLEIIENQEEEFNVNPTDLVETAKKILDFFEKCNTHPEHWQEVSEWMSQRVHNRYNWHLYSNQLLLLAKMFTFWNFVAPENNEARDRYMETLFHLIYKPRAEKILEKHMGANS

SEQ ID NO: 8925 - protein, 806 aa, Vicia faba
MATERLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVENLQPAEFLKFKEELVDGSANGNFVLELDFEPFTASFPRPTLNKSIGNGVQFLNRHLSAKLFHDKESLHPLLEFLRLHSYKGKTLMLNDRIQNPDSLQHVLRKAEEYLSTVDPETPYSEFEHRFQEIGLERGWGDSAERVLESIQLLLDLLEAPDPCTLETFLDRIPMVFNVVILSPHGYFAQDDVLGYPDTGGQVVYILDQVRALESEMLNRIKKQGLDIVPRILIITRLLPDAVGTTCGQRLEKVYGTEHCHILRVPFRDQKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADQTIYFPYTETSRRLTSFYPEIEELLYSTVENEEHICVLKDRSKPIIFTMARLDRVKNITGLVEWYGKNAKLRELVNLVVVAGDRRKESKDLEEKAEMKKMYELIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKADPSHWDKISLGGLQRIEEKYTWQIYSQRLLTLTGVYGFWKHVSNLDRLESRRYLEMFYALKYRKLAESVPLAVEE

SEQ ID NO: 8926 - protein, 1057 aa, Citrus unshiu
MAGNDWINSYLEAILDVGPGLDDAKSSLLLRERGRFSPTRYFVEEVITGFDETDLHRSWVKAQATRSPQERNTRLENMCWRIWNLARQKKQLEGEAAQRMAKRRLERERGRREATADMSEDLSEGEKGDIVSDVSAHGDSTRSRLPRISSVDAMETWISQQKGKKLYIVLISIHGLIRGENMELGRDSDTGGQVKYVVELARALGSMPGVYRVDLLTRQVSAPDVDWSYGEPTEMLTPRNSDDFMDDMGESSGAYIIRIPFGPKDKYIAKELLWPHIPEFVDGALNHIIRMSNVLGEQIGGGKPVWPVAIHGHYADAGDSAALLSGALNVPMLFTGHSLGRDKLEQLLKQARLSRDEINATYKIMRRIEAEELSLDASEIVITSTRQEIEEQWRLYDGFDPVLERKLRARIKRNVSCYGKFMPRMAIIPPGMEFHHIVPQDGDMDGETEGNEDNPASPDPPIWSEIMRFFTNPRKPVILALARPDPKKNITTLVKAFGECRPLRELANLTLIMGNRDGIDEMSSTSASVLLSVLKLIDKYDLYGQVAYPKHHKQSDVPEIYRLAAKTKGVFINPAFIEPFGLTLIEAAAHGLPIVATKNGGPVDIHRVLDNGLLVDPHDQQSIADALLKLVAGKQLWARCRQNGLKNIHLFSWPEHCKTYLSRIAGCKPRHPQWQRTDDGGETSESDSPGDSLRDIQDISLNLKFSLDGEKSGASGNDDSLDSEGNVADRKSRLENAVLAWSKGVLKDTRKSGSTDKVDQNTGAAKFPALRRRKHIFVISVDCDSTTGLLDATKKICEAVEKERTEGSIGFILSTSMTISEIHSFLVSGHLSPSDFDAFICNSGSDLYYSTLNSEDGPFVVDFYYHSHIEYRWGGEGLRKTLVRWASQVTDKKAESGEKVLTPAEQLSTNYCYAFSVQKPGMTPPVKELRKVLRIQALRCHVIYCQNGSRVNVIPVLASRSQALRYLYLRWGVELSKMVVFVGESGDTDYEGLLGGVHKTVILKGICSSSSNQIHANRSYPLSDVMPIDSPNIVQTPEDCTTSDIRSSLEQLGLLKV

SEQ ID NO: 8927 - protein, 977 aa, Oryza sativa
MYGNDNWINSYLDAILDAGKGAAASASASAVGGGGGAGDRPSLLLRERGHFSPARYFVEEVITGYDETDLYKTWLRANAMRSPQEKNTRLENMTWRIWNLARKKKELEKEEANRLLKRRLETERPRVETTSDMSEDLFEGEKGEDAGDPSVAYGDSTTGNTPRISSVDKLYIVLISLHGLVRGENMELGRDSDTGGQVKYVVELAKALSSCPGVYRVDLFTRQILAPNFDRSYGEPVEPLASTSFKNFKQERGENSGAYIIRIPFGPKDKYLAKEHLWPFIQEFVDGALSHIVKMSRAIGEEISCGHPAWPAVIHGHYASAGVAAALLSGALNVPMVFTGHFLGKDKLEELLKQGRQTREQINMTYKIMCRIEAEELALDASEIVIASTRQEIEEQWNLYDGFEVILARKLRARVKRGANCYGRYMPRMVIIPPGVEFGHMIHDFDMDGEEDGPSPASEDPSIWSEIMRFFTNPRKPMILAVARPYPEKNITTLVKAFGECRPLRELANLTLIMGNREAISKMHNMSAAVLTSVLTLIDEYDLYGQVAYPKRHKHSEVPDIYRLAVRTKGAFVNVPYFEQFGVTLIEAAMHGLPVIATKNGAPVEIHQVLDNGLLVDPHDQHAIADALYKLLSEKQLWSKCRENGLKNIHQFSWPEHCKNYLSRISTLGPRHPAFASNEDRIKAPIKGRKHVTVIAVDSVSKEDLIRIVRNSIEAARKENLSGSTGFVLSTSLTIGEIHSLLMSAGMLPTDFDAFICNSGSDLYYPSCTGDTPSNSRVTFALDRSYQSHIEYHWGGEGLRKYLVKWASSVVERRGRIEKQVIFEDPEHSSTYCLAFKVVNPNHLPPLKELQKLMRIQSLRCHALYNHGATRLSVIPIHASRSKALRYLSVRWGIELQNVVVLVGETGDSDYEELFGGLHKTVILKGEFNTSANRIHSVRRYPLQDVVALDSPNIIGIEGYGTDDMRSALKQLDIRAQ

SEQ ID NO: 8928 - protein, 809 aa, Zea mays
MSAPKLDRNPSIRDRVEDTLHAHRNELVALLSKYVNKGKGILQPHHILDALDEVQGSGGRALAEGPFLDVLRSAQEAIVLPPFVAIAVRPRPGVWEYVRVNVHELSVEQLTVSEYLRFKEELVDGQHNDPYVLELDFEPFNVSVPRPNRSSSIGNGVQFLNRHLSSIMFRNRDCLEPLLDFLRGHRHKGHVMMLNDRIQSLGRLQSVLTKAEEHLSKLPADTPYSQFAYKFQEWGLEKGWGDTAGHVLEMIHLLLDIIQAPDPSTLEKFLGRIPMIFNVVVVSPHGYFGQANVLGLPDTGGQIVYILDQVRALENEMVLRLKKQGLDVSPKILIVTRLIPDAKGTSCNQRLERISGTQHTYILRVPFRNENGILKKWISRFDVWPYLETFAEDAAGEIAAELQGTPDFIIGNYSDGNLVASLLSYKMGITQCNIAHALEKTKYPDSDIFWKNFDEKYHFSCQFTADIIAMNNADFIITSTYQEIAGSKNTVGQYESHTAFTLPGLYRVVHGIDVFDPKFNIVSPGADMSIYFPHTEKAKRLTSLHGSIENLIYDPEQNDEHIGHLDDRSKPILFSMARLDRVKNITGLVEAFAKCAKLRELVNLVVVAGYNDVNKSKDREEIAEIEKMHELIKTHNLFGQFRWISAQTNRARNGELYRYIADTHGAFVQPAFYEAFGLTVVEAMTCGLPTFATLHGGPAEIIEHGVSGFHIDPYHPEQAANLMADFFDRCKQDPDHWVNISGAGLQRIYEKYTWKIYSERLMTLAGVYGFWKYVSKLERLETRRYLEMFYILKFRELAKTVPLAIDQPQ

SEQ ID NO: 8929 - protein, 1081 aa, Craterostigma plantagineum
MAGNEWINGYLEAILDTGASAIDENSGGGKTAAAQKGRHHDHHFNPTKYFVEEVVSGVDESDLHRTWIKVVATRNTRERSSRLENMCWRIWHLTRKKKQLEWEDLQRLAARKWEREQGRKDVTEDMSEDLSEGEKGDVMGETPVALDSPRGNKKYHRNFSNLEVWSDSNKEKKLYIVLISLHGLVRGENMELGRDSDTGGQIKYVVEVARALAKMPGVYRVDLFTRQISSPEVDWSYAEPTEMLSSSSTTAGEAHEPEEEEEEEDLGEGSGAYIIRIPFGPRDKYLRKELLWPHIQEFVDGALSHIVNMSKALGDQIGGGQPVWPYVIHGHYADAGDSAALLSGALNVPMVLTGHSLGRNKLEQLLKQGRQTKEDINSMYRIMRRIEAEELSLDAAELVITSTKQEIEEQWGLYDGFDVKLERVLRARARRGVNCHGRFMPRMAVIPPGMDFSNVVVPEDGSEGDGDLATLTEATSPRSVPAIWADVMRFLTNPHKPMILALSRPDPKKNITTLVKAFGECRPLRELANLTLIMGNRDDIDEMSGGNASVLTTVLKLIDRYDLYGQVAFPKHHKQSDVPEIYRLASKTKGVFINPAFIEPFGLTLIEAAAHGLPMVATKNGGPVDIHRALNNGLLVDPHDQDAIANALLKLVSEKNLWNECRKNGLKNIHLFSWPEHCRTYLTRVAACRMRHPQWKTDTPLDETAIDDSLNDSLKDVLDMSLRLSVDGEKMSVNESSSVELPGGEAAELPDQVRRVLNKIKRQDSGPAQREAEGKAGDVPGKYPMLRRRRKLFVIALDCYDLKGNPDKKMILSIQEIVRAVRLDPQMSRFSGFALSTAMPVAELADFLKAGDVKVNDFDALICSSGSEVYYPGTYGEESGKLYLDPDYTSHIEYRWGGDGLKKTISKLMNTAEDGKSSVASSPIELVAKSSNSHCLSYAIKDPSKAKKVDDMRQKLRMRGLRCHLMYCRNSTSMQVVPLLASRSQALRYLFVRWRLSVANMYVILGETGDTDYEELISGTHKTLIMRGVVEKGSEELLRTAGSYLRDDVIPQDTPLIAYADKGAKAEHIVETFRQLSKAGM

SEQ ID NO: 8930 - protein, 806 aa, Cichorium intybus
MAEKVFTRVHSLRERLDSTLATHRNEILMVLSRIESHGKGILKPHQLMAEFDAISKEDNKLHDGAFHEVLKSTQEAIVLPPWVALAIRLRPGVWEYVRVNVNALVVEELSVPEYLHFKEELVSGDSNGNFVLELDFEPFTASFPRPTLTKSIGNGVEFLNRHLSAKMFHDKDSMHPLLDFLRTHACKGKTMMLNDRIQNLNSLQAVLRKASEYLSTLDAATPYSEFAHKFQEIGLERGWGDKAEGVMEMIHMLLDLLEAPDACTLEKFLGRIPMVFNVVILSPHGYFAQENVLGYPDTGGQVVYILDQVPALEREMLKRIKEQGLDIVPRILIVTRLLPDAVGTTCGQRLEKVFGAEHSHILRVPFRNEKGILRKWISRFEVWPYIETFTEDVAKEVTAELQGKPDLIIGNYSEGNLVASLLAHKLGVTQCTIAHALEKTKYPDSDIYWKNFDQKYHFSSQFTADLIAMNHTDFIITSTFQEIAGSKDTVGQYESHTAFTMPGLYRVVHGIDVFDPKFNIVSPGADMGIYFSYTEKENVVLTALHPEIDELLFSSVENEEHLCVLKDKKKPILFTMARLDNVKNLTGLVEWYAKNDKLRELVNLVVVGGDRRKESKDLEEQAQMKKMYDLIDEYKLNGQFRWISSQMNRIRNGELYRVIADTRGAFIQPAFYEAFGLTVVEAMTCGLPTFATLHGGPAEIIVHGKSGFHIDPYHGDQVTDLLVKFFEKTKVDPSHWEAISKGAEQRIQEKYTWQIYSDRLLTLAGVYGFWKHVSKLDRLEIRRYLEMFYALKYRKMAESVPLAVDE

SEQ ID NO: 8931 - protein, 805 aa, Solanum lycopersicum
MAERVLTRVHRLRERVDATLCAHRNEILLFLSRIESHGKGILKPHELLAEFDAIRQDDKDKLNEHAFEELLKSTQEAIVLPPWVALAIRLRPGVWEYVRVNVNALVVEELSVPEYLQFKEELVDGASNGNFVLELDFEPFTASFPKPTLTKSIGNGVEFLNRHLSAKMFHDKESMAPLLEFLRAHHYKGKTMMLNDRIHNSNTLQNVLRKAEEYLIMLPPETPFFEFEHKFQEIGLEKGWGDTAERVLEMVCMLLDLLEAPDSCTLEKFLGRIPMVFNVVILSPHGYFAQENVLGYPDTGGQVVYILDQVPALEREMLKRIKEQGLDIIPRILIVTRLLPDAVGTTCGQRLEKVYGTEHSHILRVPFGTEKGIVRKWISRFEVWPYMETFIEDVAKEISAELQAKPDLIIGNYSEGNLAASLLAHKLGVTQCTIAHALEKTKYPDSDIYWKKFDEKYHFSSQFTADLIAMNHTDFIITSTFQEIAGSKDTVGQYESHMAFTMPGLYRVVHGINVFDPKFNIVSPGADINLYFPYSESEKRLTAFHPEIDELLYSDVENDEHLCVLKDRTKPILFTMARLDRVKNLTGLVEWYAKNPRLRGLVNLVVVGGDRRKESKDLEEQAEMKKMYELIETHNLNGQFRWISSQMNRVRNGELYRYIADTKGAFVQPAFYEAFGLTVVEAMTCGLPTFATNHGGPAEIIVHGKSGFHIDPYHGEQAADLLADFFEKCKKEPSHWETISTGGLKRIQEKYTWQIYSERLLTLAAVYGFWKHVSKLDRLEIRRYLEMFYALKYRKMAEAVPLAAE

SEQ ID NO: 8932 - protein, 807 aa, Arabidopsis thaliana
MPTGRFETMREWVYDAISAQRNELLSLFSRYVAQGKGILQSHQLIDEFLKTVKVDGTLEDLNKSPFMKVLQSAEEAIVLPPFVALAIRPRPGVREYVRVNVYELSVDHLTVSEYLRFKEELVNGHANGDYLLELDFEPFNATLPRPTRSSSIGNGVQFLNRHLSSIMFRNKESMEPLLEFLRTHKHDGRPMMLNDRIQNIPILQGALARAEEFLSKLPLATPYSEFEFELQGMGFERGWGDTAQKVSEMVHLLLDILQAPDPSVLETFLGRIPMVFNVVILSPHGYFGQANVLGLPDTGGQVVYILDQVRALENEMLLRIQKQGLEVIPKILIVTRLLPEAKGTTCNQRLERVSGTEHAHILRIPFRTEKGILRKWISRFDVWPYLETFAEDASNEISAELQGVPNLIIGNYSDGNLVASLLASKLGVIQCNIAHALEKTKYPESDIYWRNHEDKYHFSSQFTADLIAMNNADFIITSTYQEIAGSKNNVGQYESHTAFTMPGLYRVVHGIDVFDPKFNIVSPGADMTIYFPYSDKERRLTALHESIEELLFSAEQNDEHVGLLSDQSKPIIFSMARLDRVKNLTGLVECYAKNSKLRELANLVIVGGYIDENQSRDREEMAEIQKMHSLIEQYDLHGEFRWIAAQMNRARNGELYRYIADTKGVFVQPAFYEAFGLTVVESMTCALPTFATCHGGPAEIIENGVSGFHIDPYHPDQVAATLVSFFETCNTNPNHWVKISEGGLKRIYERYTWKKYSERLLTLAGVYAFWKHVSKLERRETRRYLEMFYSLKFRDLANSIPLATDEN

SEQ ID NO: 8933 - protein, 808 aa, Arabidopsis thaliana
MANAERMITRVHSQRERLNETLVSERNEVLALLSRVEAKGKGILQQNQIIAEFEALPEQTRKKLEGGPFFDLLKSTQEAIVLPPWVALAVRPRPGVWEYLRVNLHALVVEELQPAEFLHFKEELVDGVKNGNFTLELDFEPFNASIPRPTLHKYIGNGVDFLNRHLSAKLFHDKESLLPLLKFLRLHSHQGKNLMLSEKIQNLNTLQHTLRKAEEYLAELKSETLYEEFEAKFEEIGLERGWGDNAERVLDMIRLLLDLLEAPDPCTLETFLGRVPMVFNVVILSPHGYFAQDNVLGYPDTGGQVVYILDQVRALEIEMLQRIKQQGLNIKPRILILTRLLPDAVGTTCGERLERVYDSEYCDILRVPFRTEKGIVRKWISRFEVWPYLETYTEDAAVELSKELNGKPDLIIGNYSDGNLVASLLAHKLGVTQCTIAHALEKTKYPDSDIYWKKLDDKYHFSCQFTADIFAMNHTDFIITSTFQEIAGSKETVGQYESHTAFTLPGLYRVVHGIDVFDPKFNIVSPGADMSIYFPYTEEKRRLTKFHSEIEELLYSDVENKEHLCVLKDKKKPILFTMARLDRVKNLSGLVEWYGKNTRLRELANLVVVGGDRRKESKDNEEKAEMKKMYDLIEEYKLNGQFRWISSQMDRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEEKYTWQIYSQRLLTLTGVYGFWKHVSNLDRLEARRYLEMFYALKYRPLAQAVPLAQDD

SEQ ID NO: 8934 - protein, 805 aa, Tulipa gesneriana
MTERRLTRIHSIKERLGDSLSHHPNELLALFSRFIKQGKGMLERHQLLTEYESVIPEADREKLKDGVFEDTLRASQEAIVIPPWVALAIRPRPGVWEYVRVNVNELAVEECSEYLKFKEDLVDRSSQSNFVLEMDFEPFNANVPRPSLSKSIGNGVQFLNRHLSSKLFHDKESLYPLLNFLREHNYKGTTLMLNDRLQSLSALQTALRKADRYLLSISKDTPYSEFNHSFQVLGLEKGWGDTASRVSENIHLLLDLLEAPDPSTLEKFLGTIPMVFNVVILSPHGYFAQANVLGYPDTGGQVVYILDQVRALETEMLLKIKQQGLDITPRILIVTRLLPDAVGTTCGQRLERVLGTEHTHILRVPFRTDKGILRKWISRFEVWPYLETYAEDVAHELAGEMQATPDLIIGNYSDGNLVASLLAHRLGITQCTIAHALEKTKYPNSDIYLKKFDDQYHFSCQFTADLIAMNQSDFIITSTFQEIAGSKDTVGQYESHTAFTLPGLYRVVHGIDVFDPKFNIVSPGADMSIYYPYFEQEKRLTALHAEIEELLYSSVENEEHKFVLKDRNKPIIFSMARLDRVKNMTGLVELYGKNDRLKELVNLVVVAGDHGKESKDLEEQAELKKMYKLIEEYKLQGHIRWISAQMNRVRNGELYRYIADTKGAFVQPAFYEAFGLTVVESMTCGLPTFATCHGGPAEIIVHGVSGFHIDPYHGDKASEQLVSFFEKCKEDPAHWEKISQGGLQRIYEKYTWKLYSERLMTLAGVYGFWKYVSNLDRRETRRYLEMFYALKYRNLAKSVPLAIDN

SEQ ID NO: 8935 - protein, 836 aa, Arabidopsis thaliana
MEMTSGSLGNGIPEAMGQNRGNIKRCLEKYIENGRRVMKLNELMDEMEIVINDVTQRRRVMEGDLGKILCFTQAVVIPPNVAFAVRGTPGNWQYVKVNSSNLSVEALSSTQYLKLKEFLFDENWANDENALEVDFGALDFTLPWLSLSSSIGNGLSFVSSKLGGRLNDNPQSLVDYLLSLEHQGEKLMMNETLNTARKLEMSLILADVFLSELPKDTPFQAFELRFKECGFEKGWGESAGRVKETMRILSEILQAPDPQNIDRFFARVPRIFNVVIFSVHGYFGQTDVLGLPDTGGQVVYILDQVKALEDELLQRINSQGLNFKPQILVVTRLIPDAKKTKCNQELEPIFGTKYSNILRIPFVTENGILRRWVSRFDIYPYLERFTKDATTKILDILEGKPDLIIGNYTDGNLVASLMANKLGITQATIAHALEKTKYEDSDIKWKEFDPKYHFSSQFTADLISMNSADFIIASTYQEIAGSKERAGQYESHMSFTVPGLYRVVSGINVFDPRFNIAAPGADDSIYFPFTAQDRRFTKFYTSIDELLYSQSENDEHIGYLVDKKKPIIFSMARLDVVKNLTGLTEWYAKNKRLRDLVNLVIVGGFFDASKSKDREEISEIKKMHSLIEKYQLKGQFRWITAQTDRTRNGELYRSIADTRGAFVQPAHYEAFGLTVIEAMSCGLVTFATNQGGPAEIIVDGVSGFHIDPSNGEESSDKIADFFEKSGMDPDYWNMFSNEGLQRINECYTWKIYANKVINMGSTYSYWRHLNKDQKLAKQRYIHSFYNLQYRNLVKTIPILSDIPEPPPLPPKPLVKPSASKGSKRTQPRLSFRLFGA

SEQ ID NO: 8936 - protein, 963 aa, Oryza sativa
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRLLKRQPEAEKLRTDTNADMSEDLFEGEKGEDAGDPSVAYGDSTTGSSPKTSSIDKLYIVLISLHGLVRGENMELGRDSDTGGQVKYVVELAKALSSSPGVYRVDLLTRQILAPNFDRSYGEPTEMLVSTSFKNSKQEKGENSGAYIIRIPFGPKDKYLAKEHLWPFIQEFVDGALGHIVRMSKTIGEEIGCGHPVWPAVIHGHYASAGIAAALLSGSLNIPMAFTGHFLGKDKLEGLLKQGRHSREQINMTYKIMCRIEAEELSLDASEIVIASTRQEIEEQWNLYDGFEVILARKLRARVKRGANCYGRYMPRMVIIPPGVEFGHIIHDFEMDGEEENPCPASEDPPIWSQIMRFFTNPRKPMILAVARPYPEKNITSLVKAFGECRPLRELANLTLIMGNREAISKMNNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKQLWSRCRENGLKNIHQFSWPEHCKNYLSRILTLGPRSPAIGGKQEQKAPISGRKHIIVISVDSVNKEDLVRIIRNTIEVTRTEKMSGSTGFVLSTSLTISEIRSLLVSAGMLPTVFDAFICNSGSNIYYPLYSGDTPSSSQVTPAIDQNHQAHIEYRWGGEGLRKYLVKWATSVVERKGRIERQIIFEDPEHSSTYCLAFRVVNPNHLPPLKELRKLMRIQSLRCNALYNHSATRLSVVPIHASRSQALRYLCIRWGIELPNVAVLVGESGDSDYEELLGGLHRTVILKGEFNIPANRIHTVRRYPLQDVVALDSSNIIGIEGYSTDDMKSALQQIGVLTQ

SEQ ID NO: 8937 - protein, 1059 aa, Vicia faba
MAGNDWLNSYLEAILDVGPGLDDAKSSLLLRERGRFSPTRYFVEEVIGFDETDLYRSWVRASSSRSPQERNTRLENMCWRIWNLARQKKQLESEAVQRVNKRRLERERGRREATADMSEDLSEGERGDPVSDVSTHGGGDSVKSRLPRISSADAMETWVNSQKGKKLYIVLISIHGLIRGENMELGRDSDTGGQVKYVVELARALGSMPGVYRVDLLTRQVSSPDVDWSYGEPTEMLAPRNTDEFGDDMGESSGAYIIRIPFGPRNKYIPKEELWPYIPEFVDGAMGHIIQMSKALGEQIGSGHAVWPVAIHGHYADAGDSAALLSGALNVPMIFTGHSLGRDKLEQLLKQGRLSTDEINSTYKIMRRIEAEELALDGTEIVITSTRQEIEEQWRLYNGFDPVLERKIRARIRRNVSCYGRYMPRMSVIPPGMEFHHIAPLDGDIETEPEGILDHPAPQDPPIWSEIMRFFSNPRKPVILALARPDPKKNITTLVKAFGECRPLRELANLTLIMGNRDGIDEMSSTSSSVLLSVLKLIDKYDLYGQVAYPKHHKQSDVPDIYRLAAKTKGVFINPAFIEPFGLTLIEAAAYGLPMVATKNGGPVDIHRVLDNGLLIDPHDEKSIADALLKLVSNKQLWAKCRQNGLKNIHLFSWPEHCKTYLSKIATCKPRHPQWQRSEDGGESSESEESPGDSLRDIQDLSLNLKFSLDGERSGDSGNDNSLDPDGNATDRTTKLENAVLSWSKGISKDTRRGGATEKSGQNSNASKFPPLRSRNRLFVIAVDCDTTSGLLEMIKLIFEAAGEERAEGSVGFILSTSLTISEIQSFLISGGLSPNDFDAYICNSGSDLYYPSLNSEDRLFVGDLYFHSHIEYRWGGEGLRKTLIRWASSITDKKSENNEQIVSPAEQLSTDYCYAFNVRKAGMAPPLKELRKLMRIQALRCHPIYCQNGTRLNVIPVLASRSQALRYLYVRWGFELSKMVVFVGECGDTDYEGLVGGLHKSVILKGVGSRAISQLHNNRNYPLSDVMPLDSPNIVQATEGSSSADIQALLEKVGYHKG

SEQ ID NO: 8938 - protein, 942 aa, Arabidopsis thaliana
MSSSSQAMLQKSDSIAEKMPDALKQSRYHMKRCFASFVGGGKKLMKREHLMNEIEKCIEDSRERSKILEGLFGYILTCTQEAAVVPPFVALAARPNPGFWEYVKVNSGDLTVDEITATDYLKLKESVFDESWSKDENALEIDFGAIDFTSPRLSLSSSIGKGADYISKFISSKLGGKSDKLEPLLNYLLRLNHHGENLMINDDLNTVAKLQKSLMLAVIVVSTYSKHTPYETFAQRLKEMGFEKGWGDTAERVKETMIILSEVLEAPDNGKLDLLFSRLPTVFNVVIFSVHGYFGQQDVLGLPDTGGQVVYILDQVRALEEELLIRINQQGLGFKPQILVVTRLIPEARGTKCDQELEAIEGTKHSHILRVPFVTNKGVLRQWVSRFDIYPYLERFTQDATSKILQRLDCKPDLIIGNYTDGNLVASLMATKLGVTQGTIAHALEKTKYEDSDAKWKELDPKYHFSCQFTADLIAMNVTDFIITSTYQEIAGSKDRPGQYESHTAFTMPGLCRVVSGIDVFDPKFNIAAPGADQSVYFPYTEKDKRFTKFHPSIQELLYNEKDNAEHMGYLADREKPIIFSMARLDTVKNITGLVEWYGKDKRLREMANLVVVAGFFDMSKSNDREEKAEIKKMHDLIEKYKLKGKFRWIAAQTDRYRNSELYRCIADTKGVFVQPALYEAFGLTVIEAMNCGLPTFATNQGGPAEIIVDGVSGFHIDPNNGDESVTKIGDFFSKCRSDGLYWDNISKGGLKRIYECYTWKIYAEKLLKMGSLYGFWRQVNEDQKKAKKRYIEMLYNLQFKQLTKKVTIPEDKPLPLRLASLRNLLPKKTTNLGAGSKQKEVTETEKTKQKSKDGQEQHDVKVGEREVREGLLAADASERVKKVLESSEEKQKLEKMKIAYGQQHSQGASPVRNLFWSVVVCLYICYILKQRFFGANSAQEY

SEQ ID NO: 8939 - protein, 766 aa, Beta vulgaris
AGGKQILSDGPFSEVLRSAQEAIVVPPFVAIAVRPRPGVWEYVRVNVSELNVEQLTVSEYLHFKEELVDGKADDHYVLELDFEPFNESVPRPTRSSSIGNGVQFLNRHLSSSMFCNKDCLEPLLDFLRVHKHKGVVMMLNDRIQTIQRLQSALSKAEDYLIKLPADTPYSEFEFVIQGMGFERGWGDTAERVLEMMHLLLDILQAPDPSTLETFLGRLPMVFNVVILSVHGYFGQAHVLGLPDTGGQIVYILDQVRSLEHEMLQRIKKQGLDVTPRILIVSRLIPDAKGTTCNQRMEKVSGTEHASILRVPFRSEKGILRKWISRFDVWPYLETFTEDAAGEIIGELQGRPDLIIGNYSDGNIVASLLSHKMGVTQCNIAHALEKTKYPDSDIYWKRFEDKYHFSCQFSADLMAMNHADFIITSTYQEIAGTKNTVGQYESHKAFTFPGLYRVVHGIDVFDPKFNIVSPGADMAIYFPFSEKDVTCLTSLHRLIEQLLFKPEQNEEHIGVLDDTSKPIIFSMARLDRVKNITGLVECYGKNAKLRELANLVVVAGYNDVKKSNDREEIAEIEKMHRLIQEYNLRGQFRWIASQTNRVRNGELYRYICDKGGIFAQPAFYEAFGLTVVEAMTCGLPTFATCHGGPAEIIEDGVSGFHIDPYHADQAEKMTEFFVKCREDPNYWTKISAGGLLRIKERYTWQKYSERLMTLAGVYGFWKYVSKLERRETRRYLEMFYILKFRDLANSVPLATDEEPSTTDAVATFRGP

SEQ ID NO: 8940 - protein, 806 aa, Nostoc flagelliforme
MSELLQAVLDSEEKSDLRSFLSELRQQEKKYLLRNDILNVYSEYCSKSQKPEEFYTSSELGKLIYYTQEIIQEESSFCFIIRSKIASQEVYWLTSDLSIEPMMVQDLLDLRDRLVNKYHPNEGDLLELDFGPFYDYTPVIRDPKNIGKGVQFLNRYLSSKIFQDSKQLLDSLFNFLRLHHYNGVQLLINDRIQSQQQLSEQVKKAIGFVNNRPDDEPYEQFRFQLQSMGFEPGWGNTAARVRETLNILDELIDSADPQTLEAFISRVPMIFRIVLVSAHGWFGQEGVLGRPDTGGQVVYVLDQAKSLEKQLQEDALLAGLEKLNVEPKVIILTRLIPNSDGTLCNQRLEKVHGTENAWILRVPLREFNPNMTQNWISRFEFWPYLETFAIDSERELRAEFHGTPDLIVGNYTDGNLVAFLLARRLKVTQCNVAHALEKSKYLFSNLYWQELEEKYHFSLQFTADLIAMNAANFVVSSTYQEIVGTPDSVGQYESYKCFTMPELYHVTNGIELFSPKFNVVPPGVNENNYFPYTRTKDRVESDRQRLAETLFTLEDPTQIFGKLDDPNKRPLFSMARLDHIKNLTGLAECYGQSKELQEHCNLILVAGKLRVEESGDNEERDEIIKLYQIIEEYNLHGKIRWLGVRLTKTDSGEIYRVIANHQGIFVQPALFEAFGLTILESMVSGLPTFATQFGGPLEIIQDKVNGFLINPTNLDETATKIVEFITKCEQNPNYWNEISERGIDRVYSTYTWKIHTTKLLSLARIYGFWNFTSKENREDLLRYLEALFYLIYKPRAQQLLEQHKYR

SEQ ID NO: 8941 - protein, 809 aa, Pisum sativum
MSTHPKFTRVPSIRDRVQDTLSAHRNELISLLSRYVAQGKGILQPHNLIDELDNILGEDHATLDLKNGPFGQIINSAQEAIVLPPFVAIAVRPRPGVWEYVRVNVFELSVEQLSVSEYLSFKEELVEGKSNDNIILELDLEPFNASFPRPTRSSSIGNGVQFLNRHLSSNMFRNKDCLEPLLDFLRVHTYKGHALMLNDRIQSISKLQSALVKAEDHLSKLAPDTLYSEFEYELQGTGFERGWGDTAARVLEMMHLLLDILQAPDPSTLETFLGRVPMVFNVVILSPHGFFGQANVLGLPDTGGQVVYILDQVRALESEMLVRIKKQGLDFTPRILIVTRLIPDAKGTTCNQRLERVSGTEYTHILRVPFRSEKGILRKWISRFDVWPFLETFAEDVASEIAAELQCYPDFIIGNYSDGNLVASLLAYKMGVTQCTIAHALEKTKYPDSDIYWKKFEDKYHFSCQFTADLIAMNNADFIITSTYQEIAGTKNTIGQYESHTAFTLPGLYRVVHGIDVFDPKFNIVSPGADMTIYFPYSDKEKRLTALHSSIEKLLYGTEQTDEYIGSLTDRSKPIIFSMARLDRVKNITGLVESYAKNSKLRELVNLVVVAGYIDVKKSSDREEIEEIEKMHDLMKQYNLNGEFRWITAQTNRARNGELYRYIADTKGAFVQPAFYEAFGLTVVEAMTCGLPTFATNHGGPAEIIEHGVSGFHIDPYHPDQASELLVDFFQRCKEDPNHWNKVSDGGLQRIYERYTWKIYSERLMTLAGVYSFWKYVSKLERRETRRYLEMFYILKFRDLANSVPIAKG

SEQ ID NO: 8942 - protein, 803 aa, Alnus glutinosa
MAERVLTRVHSLRERLDETLVANRNEIVALLSRIIGKGKGICRNHQLIAEVEAIPEATRKKLLDGAFGEVLRSAQEAIVLPPWVALAVRPRPGVWEYIRVNVHALVVEELRVPEYLHFKEELVDGSTNGNFVLELDFDPFNASFPRPTLSKSIGNGVEFLNRHLSAKLFHDKESMHPLLEFLRVHCYKGKNMMLNDRIQNVNALQYVLRKAEEYLTTIAPETPYVKFEHKFQEIGLVRGWGDTAEGVLEMIQLLLVLLEAPVPCTLEKFLGKSLWLNVVIMSPHGYFAQDNVGYPDTGGQVVYILDQVRALESEMLLRIKQQGLDITPRILIVTRLLPDAVGTTCGQRLERVYGSEHADILRVPFRTEKGIVRQWISRFEVWPYLETYTEDVGVELIKELQGKPDLIIGNYSDGNIVASLLAHKFGVTQCTHAHALEKTKYPESDIYWKKMDEKYHFSSQFTADLIAMNHTDFIITSTFQEIAGSKDTVGQYESHTAFTLPGLYRVVHELCIDPKFNIVSPGADMSIYFPYTEKEKRLTSFHPEIEELLYSPVENEEHLCVLKDRNKPIIFTMARLDRVKNITGLVEWYGKNTRLRELVNLVVVAGNLEKESKDNEEKAEMTKMHGLIETYKLNGQFRWISSQMNRVRNGELYRYIADTKGGLCAGPAIYEAFGLTVVESMTCGLPTFATCKGGPAEIIVHGKSGFHIDPYHGEQAAQLLVDFFEKTKADPSHWAKISLGGLQRIHEKYTWKIYSERLLTLTGVTAFWKHVSNLDRLESRRYIEMFYALKYRKLAESVPLAVE

SEQ ID NO: 8943 - protein, 801 aa, Daucus carota
MAQPLLSLRQRFESTFSSHRQEIFMFLSRIQSLGNGILKPHQLFSEFQAISKIDRLKLEDSALVQLLNSAQEAIVCSPWIALAIRLRPGVWEYVRLNVHQLVVEELTVPDYLYLKEELVNASSNGNFVLELDFAPFTASIPRPTLTKSIGNGVEFLNRHLSAKMFQDKDSMHPLLDFLRLHHHNGRTLMLNNRVQTVNGLQDILRIAGEYLSKLPSDTPYSDFEHKFQEIGFERGWGDTAEHVSEMFHMLLDLLEAPDACTLETFLGKIPMIFNVVILSPHGYFAQENVLGYPDTGGQVVYILDQVPAMEREMTKRIKEQGLDIIPRILIVTRLLPDAVGTTCNLRLEKVFGAEHSHILRVPFRTEKGILRKWISRFEVWPYMETFTEDVAKEIALELKAKPDLIIGNYSEGNLVASLLANKLGVTQCTIAHALEKTKYPDSDIYWEKFDKKYHFSSQFTADLIAMNHTDFIITSTFQEIAGSKDTVGQYESHTAFTMPGLYRVVHGIDVFDPKFNIVSPGADTSVYYPYTEKKRRLTALHPEIEDLLFSSVENKEHICVLKDRYKPILFTMARLDNVKNLTGIVEWYAKNPKLRELVNLVVVGGDRRKESKDLEEQAQMKKMYGLIDTYKLNGQFRWISAQKNRVRNGELYRCIADTKGAFVQPAFYEAFGLTVIEAMTCGLPTFATIHGGPAEIIVHGTSGFHIDPYHGEKAAELIVNFFERCKTEPSHWETISAGGLKRIQEKYTWQIYSERLLTLGGVYGFWKHVSKLDRIEIRRYLEMFCALKYRNLAESVPLAVD

SEQ ID NO: 8944 - protein, 808 aa, Daucus carota
MGEPVLTRVHSLRERMDSTLANHRNEILMFLSRIESHGKGILKPHQLLAEYEAISKEDKLKLDDGHGAFAEVIKSTQEAIVSPPWVALAIRLRPGVWEYVRVNVHHLVVEELSVPQYLQFKEELVIGSSDANFVLELDFAPFTASFPRPTLTKSIGNGVEFLNRHLSAKMFHGKDSMHPLLEFLRLHNYNGKTLMLNNRVQNVNGLQSMLRKAGDYLSTLPSDTPYSEFEHKFQEIGFERGWGDTAERVTEMFHMLLDLLEAPDASTLETFLGKIPMVFNVVILSPHGYFAQENVLGYPDTGGQVVYILDQVPALEREMIKRIKEQGLDIKPRILIVTRLLPDAVGTTCNQRLEKVFGAEHAHILRVPFRTEKGILRKWISRFEVWPYIETFTEDVAKEIALELQAKPDLIIGNYSEGNLVASLLAHKLGVTQCTIAHALEKTKYPDSDIYWEKFDKKYHFSSQFTADLIAMNHTDFIITSTFQEIAGSKDTVGQYESHTAFTMPGLYRVVHGIDVFDPKFNIVSPGADTSVYFSYKEKEKRLTTLHPEIEELLYSSVENEEHLCIIKDKNKPILFTMARLDNVKNLTGFVEWYAKSPKLRELVNLVVVGGDRRKESKDLEEQAQMKKMYELIDTYKLNGQFRWISSQMNRVRNGELYRYIADTKGAFVQPAFYEAFGLTVVEAMTCGLPTFATLHGGPAEIIVHGKSGFHIDPYHGEQVAELLVNFFEKCKTDPSQWDAISAGGLKRIQEKYTWQIYSERLLTLAGVYGFWKHVSKLDRLEIRRYLEMFYALKYRKLAESVPLAKDE

SEQ ID NO: 8945 - protein, 802 aa, Zea mays
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGQSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDEISQGGLQRIYEKYTWKLYSERLMTLTGVYGFWKYVSNLERRETRRYIEMFYALKYRSLASQVPLSFD

SEQ ID NO: 8946 - protein, 1045 aa, Beta vulgaris
MAGNDWINSYLEAILDVGPGLDDAKSSLLLRERGRFSPTRYFVEEVITGFDETDLHRSWVRAQATRSPQERNTRLENMCWRIWNLARQKKQLENEEAQRKTKRRMELERGRREATADMSEDLSEGEKDISAHGDSTRPRLPRINSLDAMETWISQQKEKKLYLVLISLHGLIRGENMELGRDSDTGGQVKYVVELARALGSMPGVYRVDLLTRQVSSPDVDWSYGEPTEMLNPRDSNGFDDDDDEMGESSGAYIVRIPFGPRDKYIAKEELWPYIPEFVDGALNHIVQMSKVLGEQIGSGETVWPVAIHGHYADAGDSAALLSGGLNVPMLLTGHSLGRDKLEQLLKQGRMSKDDINNTYKIMRRIEAEELSLDASEIVITSTRQEIEEQWHLYDGFDPVLERKLRARMKRGVSCYGRFMPRMVVIPPGMEFNHIVPHEGDMDGETEETEEHPTSPDPPIWAEIMRFFSKPRKPMILALARPDPKKNITTLVKAFGECRPLRELANLTLIMGNRDGIDEMSSTSSSVLLSVLKLIDQYDLYGQVAYPKHHKQADVPEIYRLAAKTKGVFINPAFIEPFGLTLIEAAAHGLPMVATKNGGPVDIQRVLDNGLLVDPHEQQSIATALLKLVADKQLWTKCQQNGLKNIHLYSWPEHSKTYLSRIASSRQRQPQWQRSSDEGLDNQEPESPSDSLRDIKDISLNLEVLVRPEKRVKTLKILGLMTKANSRMLLCSWSNGVHKMLRKARFSDKVDQASSKYPAFRRRKLIYVIAVDGDYEDGLFDIVRRIFDAAGKEKIEGSIGFILSTSYSMPEIQNYLLSKGFNLHDFDAYICNSGSELYYSSLNSEESNIIADSDYHSHIEYRWGGEGLRRTLLRWAASITEKNGENEEQVITEDEEVSTGYCFAFKIKNQNKVPPTKELRKSMRIQALRCHVIYCQNGSKMNVIPVLASRSQALRYLYVRWGVELSKMVVFVGECGDTDYEGLLGGVHKTVILKGVSNTALRSLHANRSYPLSHVVSLDSPNIGEVSKGCSSSEIQSIVTKLSKA

SEQ ID NO: 8947 - protein, 1047 aa, Arabidopsis thaliana
MVGNDWVNSYLEAILAAEPGIANSKPPGTGDSKSSLLLRERGHFSPTRYFVEEVITGFDETDLHRSWVQAAATRSPQERNTRLENLCWRIWNLARQKKQVEGKNAKREAKREREREKARREVTAEMSEDFSEGEKADLPGEIPTPSDNNTKGRMSRISSVDVFENWFAQHKEKKLYIVLISLHGLIRGENMELGRDSDTGGQVKYVVELARALGSMPGVYRVDLLTRQVTAPDVDSSYSEPSEMLNPIDTDIEQENGESSGAYIIRIPFGPKDKYVPKELLWPHIPEFVDRALSHIMQISKVLGEQIGGGQQVWPVSIHGHYADAGDSTALLSGALNVPMVFTGHSLGRDKLEQLLKQGRPKEEINSNYKIWRRIEAEELCLDASEIVITSTRQEVDEQWRLYDGFDPVLERKLRARMKRGVSCLGRFMPRMVVIPPGMEFHHIVPHDVDADGDDENPQTADPPIWSEIMRFFSNPRKPMILALARPDPKKNLVTLVKAFGECRPLRELANLTLIMGNRNDIDELSSTNSSVLLSILKLIDKYDLYGQVAMPKHHQQSDVPEIYRLAAKTKGVFINPAFIEPFGLTLIEAGAHGLPTVATINGGPVDIHRVLDNGLLVDPHDQQAIADALLKLVSDRQLWGRCRQNGLNNIHLFSWPEHCKTYLARIASCKQRHPKWQRVEFENSDSDSPSDSLRDINDISLNLKLSLDGEKSGSNNGVDTNLDAEDRAAERKAEVEKAVSTLAQKSKPTEKFDSKMPTLKRRKNIFVISVDCSATSDLLAVVKTVIDAAGRGSSTGFILSTSMTISETHTALLSGGLKPQDFDAVICSSGSELYFTSSGSEDKTALPYTLDADYHSHIEFRWGGESLRKTLIRWISSVEEKKKTKKGEILVEDESSSTNYCLSFKVKDPALMPPMKELRKLMRNQALRCNAVYCQNGARLNVIPVLASRSQALRYLLVRWGIDLSNMVVFVGDSGDTDYEGLLGGIHKTVILKGLASDLREQPGNRSYPMEDVTPLNSPNITEAKECGRDAIKVALEKLGISLLKP

SEQ ID NO: 8948 - protein, 809 aa, Arabidopsis thaliana
MANPKLTRVLSTRDRVQDTLSAHRNELVALLSRYVDQGKGILQPHNLIDELESVIGDDETKKSLSDGPFGEILKSAMEAIVVPPFVALAVRPRPGVWEYVRVNVFELSVEQLTVSEYLRFKEELVDGPNSDPFCLELDFEPFNANVPRPSRSSSIGNGVQFLNRHLSSVMFRNKDCLEPLLDFLRVHKYKGHPLMLNDRIQSISRLQIQLSKAEDHISKLSQETPFSEFEYALQGMGFEKGWGDTAGRVLEMMHLLSDILQAPDPSSLEKFLGMVPMVFNVVILSPHGYFGQANVLGLPDTGGQVVYILDQVRALETEMLLRIKRQGLDISPSILIVTRLIPDAKGTTCNQRLERVSGTEHTHILRVPFRSEKGILRKWISRFDVWPYLENYAQDAASEIVGELQGVPDFIIGNYSDGNLVASLMAHRMGVTQCTIAHALEKTKYPDSDIYWKDFDNKYHFSCQFTADLIAMNNADFIITSTYQEIAGTKNTVGQYESHGAFTLPGLYRVVHGIDVFDPKFNIVSPGADMTIYFPYSEETRRLTALHGSIEEMLYSPDQTDEHVGTLSDRSKPILFSMARLDKVKNISGLVEMYSKNTKLRELVNLVVIAGNIDVNKSKDREEIVEIEKMHNLMKNYKLDGQFRWITAQTNRARNGELYRYIADTRGAFAQPAFYEAFGLTVVEAMTCGLPTFATCHGGPAEIIEHGLSGFHIDPYHPEQAGNIMADFFERCKEDPNHWKKVSDAGLQRIYERYTWKIYSERLMTLAGVYGFWKYVSKLERRETRRYLEMFYILKFRDLVKTVPSTADD

SEQ ID NO: 8949 - protein, 846 aa, Oryza sativa
MAVGLRRSDSIADMMPEALRQSRYQMKRCFQRYVSQGKRLMKRQQLLDELDKSVDDKADKDQLLQGFLGYVISSTQEAAVLPPFVAFAVRMNPGIWEFVKVHSANLSVEQMTPSDYLKNKEALVDDKWGAYDDDSQLEVDFGALDLSTPHLTLPSSIGKGAHLVSRFMSSKLTDNKKPLLDYLLALSHRGDKLMINDILDTVDKLQTALLLAEVYVAGLHPDTNYSEFEQKFQEWGLEKGWGDTAETCKETLSSLSEVLQAPDPINMEKFFSTVPCVFTVVIFSIHGYFGQEKVLGMPDTGGQVVYILDQVRALEDELLQRIKQQGLNATPKILVLTRLIPEAKGTKCNVELEPIENTKHSNILRVPFKTEDGKVLPQWVSRFDIYPYLERYAQDSSVKILEILEGKPDLVIGNYTDGNLVASLLTSKLGVTQGTIAHALEKTKYEDSDIKWRELDHKYHFSCQFTADMIAMNTSDFIIASTYQEIAGSKEKPGQYESHYAFTMPGLCRYATGINVFDPKFNIAAPGADQSVYFPFTQKQKRLTDLHPQIEELLYSKEDNNEHIGHLADRSKPIIFSMARLDKIKNITGLVEWYGQNKRLRDLVNLVIVGGLLDPSQSKDREEIEEINKMHSLINKYQLVGQIRWIKGQTDRVRNGELYRCIADTKGAFVQPALYEAFGLTVIEAMNCGLPTFATNQGGPAEIIVDEVSGFHINPLNGKEASDKIADFFQKCKEDLIYWSKMSTAGLQRIYECYTWQIYATKVLNMASIYGFWRTLDKEERQAKQHYLHMFYNLQFRKLAKNVPTLGEQPAQPTESAEPNRIIPRPKERQVCPFLRNLLKKETGNN

SEQ ID NO: 8950 - protein, 820 aa, Tulipa gesneriana
MADRAMTRVHSVRERLTDTLSAHKNELLALFSRFVKQGQGMLQPHQLLTEYEAVIPAADREKLKDGVFEDVLKAAQEAIVIPPWVALAIRPRPGVWEYVRVNVSELAVEELTVPEYLQFKEELVDGSGQSNFTLELDFEPFNASFPRPSLSKSIGNGVQFLNRHLSSKLFHDKESMYPLLNFLKEHHYNGTSMMLNDRIQTLGALQASLRRADEYVLSLPLDTPYSDFGHRFQELGLEKGWGDNAKRVHENLHLLLDLLEAPDPCTLENFLGTIPMVFNVVILSPHGYFAQANVLGYPDTGGQVVYILDQVRAMESEMLLRIKQQGLDITPRILIVTRLLPDAVGTTCGQRLEKVLGTEHTHILRVPFRTEHGILRKWISRFEVWPYLETYAEDVANEVAGELQATPDLIIGNYSDGNLVASLMAHKLGVTQCTIAHALEKTKYPNSDLYWKKFEKQYHFSCQFTADLIAMNHADFIITSTFQEIAGSKDTVGQYESHTGFTLPGLYRVVHGIDVFDPKFNIVSPGADMSIYFPYTEAEKRLTALHPEIEELLYSSAESTEYKFGLKDKTKPIIFSMARLDRVKNMTGLVELYAKNDRLKELVNLVVVCGDHAKASKDLEEQAELKKMYSLIEEYKLDGHIRWISAQMNRVRNGELYRYIADSKGVFVQPAFYEAFGLTVVESMTCGLPTFATCHGGPAEIIVHGVSGYHIDPYHGDKAAELLVDFFEKSKKDQTHWDAISNGGLKRIYEKYTWKIYSERLLTLAGVYGFWKYVSNLDRRETKRYLEMFYALKYRNLAKSVPLAVDGEAAVNGKICTLGC

SEQ ID NO: 8951 - protein, 1062 aa, Arabidopsis thaliana
MAGNEWINGYLEAILDSQAQGIEETQQKPQASVNLREGDGQYFNPTKYFVEEVVTGVDETDLHRTWLKVVATRNSRERNSRLENMCWRIWHLTRKKKQLEWEDSQRIANRRLEREQGRRDATEDLSEDLSEGEKGDGLGEIVQPETPRRQLQRNLSNLEIWSDDKKENRLYVVLISLHGLVRGENMELGSDSDTGGQVKYVVELARALARMPGVYRVDLFTRQICSSEVDWSYAEPTEMLTTAEDCDGDETGESSGAYIIRIPFGPRDKYLNKEILWPFVQEFVDGALAHILNMSKVLGEQIGKGKPVWPYVIHGHYADAGDSAALLSGALNVPMVLTGHSLGRNKLEQLLKQGRQSKEDINSTYKIKRRIEAEELSLDAAELVITSTRQEIDEQWGLYDGFDVKLEKVLRARARRGVNCHGRFMPRMAVIPPGMDFTNVEVQEDTPEGDGDLASLVGGTEGSSPKAVPTIWSEVMRFFTNPHKPMILALSRPDPKKNITTLLKAFGECRPLRELANLTLIMGNRDDIDELSSGNASVLTTVLKLIDKYDLYGSVAYPKHHKQSDVPDIYRLAANTKGVFINPALVEPFGLTLIEAAAHGLPMVATKNGGPVDIHRALHNGLLVDPHDQEAIANALLKLVSEKNLWHECRINGWKNIHLFSWPEHCRTYLTRIAACRMRHPQWQTDADEVAAQDDEFSLNDSLKDVQDMSLRLSMDGDKPSLNGSLEPNSADPVKQIMSRMRTPEIKSKPELQGKKQSDNLGSKYPVLRRRERLVVLAVDCYDNEGAPDEKAMVPMIQNIIKAVRSDPQMAKNSGFAISTSMPLDELTRFLKSAKIQVSEFDTLICSSGSEVYYPGGEEGKLLPDPDYSSHIDYRWGMEGLKNTVWKLMNTTAVGGEARNKGSPSLIQEDQASSNSHCVAYMIKDRSKVMRVDDLRQKLRLRGLRCHPMYCRNSTRMQIVPLLASRSQALRYLFVRWRLNVANMYVVVGDRGDTDYEELISGTHKTVIVKGLVTLGSDALLRSTDLRDDIVPSESPFIGFLKVDSPVKEITDIFKQLSKATA

SEQ ID NO: 8952 - protein, 1050 aa, Arabidopsis thaliana
MARNDWINSYLEAILDVGTSKKKRFESNSKIVQKLGDINSKDHQEKVFGDMNGKDHQEKVFSPIKYFVEEVVNSFDESDLYKTWIKVIATRNTRERSNRLENICWRIWHLARKKKQIVWDDGVRLSKRRIEREQGRNDAEEDLLSELSEGEKDKNDGEKEKSEVVTTLEPPRDHMPRIRSEMQIWSEDDKSSRNLYIVLISMHGLVRGENMELGRDSDTGGQVKYVVELARALANTEGVHRVDLLTRQISSPEVDYSYGEPVEMLSCPPEGSDSCGSYIIRIPCGSRDKYIPKESLWPHIPEFVDGALNHIVSIARSLGEQVNGGKPIWPYVIHGHYADAGEVAAHLAGALNVPMVLTGHSLGRNKFEQLLQQGRITREDIDRTYKIMRRIEAEEQSLDAAEMVVTSTRQEIDAQWGLYDGFDIKLERKLRVRRRRGVSCLGRYMPRMVVIPPGMDFSYVLTQDSQEPDGDLKSLIGPDRNQIKKPVPPIWSEIMRFFSNPHKPTILALSRPDHKKNVTTLVKAFGECQPLRELANLVLILGNRDDIEEMPNSSSVVLMNVLKLIDQYDLYGQVAYPKHHKQSEVPDIYRLAAKTKGVFINPALVEPFGLTLIEAAAYGLPIVATRNGGPVDIVKALNNGLLVDPHDQQAISDALLKLVANKHLWAECRKNGLKNIHRFSWPEHCRNYLSHVEHCRNRHPTSSLDIMKVPEELTSDSLRDVDDISLRFSTEGDFTLNGELDAGTRQKKLVDAISQMNSMKGCSAAIYSPGRRQMLFVVAVDSYDDNGNIKANLNEIIKNMIKAADLTSGKGKIGFVLASGSSLQEVVDITQKNLINLEDFDAIVCNSGSEIYYPWRDMMVDADYETHVEYKWPGESIRSVILRLICTEPAAEDDITEYASSCSTRCYAISVKQGVKTRRVDDLRQRLRMRGLRCNIVYTHAATRLNVIPLCASRIQALRYLSIRWGIDMSKTVFFLGEKGDTDYEDLLGGLHKTIILKGVVGSDSEKLLRSEENFKREDAVPQESPNISYVKENGGSQEIMSTLEAYGIK

SEQ ID NO: 8953 - protein, 416 aa, Unknown
  Description of Unknown: Nicotiana langsdorffii x Nicotiana sanderae sequence
YFAQENVLGYPYTGGQVVYILHQVPALEREMLKRLKVQGLDITPRILIVTRLLPDAVGTTCGQRLEKVYGSEHSHILRVPFRTEKGIVRKWVSRFEVWPYMETFTEDVAKELAAELQAKPDLIIGNYSEGNLVASLLAHKLGVTQCTIAHALEKTKYPDSDIYWKKFDEKYHFSSQFTADLIAMNHTDFIITSTFQEIAGSKDTVGQYESHQAFTMPGLYRVVHGIDVFDPKFNVVSPGADINLYFPYSEKEKRLTALHPEIEELLYSDVENEEHLCVLKARNKPILFTMARLDRVKNLTGLVEWYAKNARLRELVNLVVVGDDRRKESKDLEEHAEMKKMYELIKTHNLNGQFRWISSQMNRVRNGELYRYIADTRGAFVQPAFYEAFGLTVVEAMTCGLPTFATNHGGPAEIIV

SEQ ID NO: 8954 - protein, 1014 aa, Oryza sativa
MVHHYSMSCPDLEAIEQVEWEFSRQLSRRRLEQELGSREAAADLSELSEGEKDGKPDTHPPPAAAAAEAAADDGGGGDHQQQQQQPPPHQLSRFARINSDPRIVSDEEEEVTTDRNLYIVLISIHGLVRGENMELGRDSDTGGQVKYVVELARALAATPGVHRVDLLTRQISCPDVDWTYGEPVEMLTVPAADADDEDGGGGSSGGAYIVRLPCGPRDKYLPKESLWPHIPEFVDRALAHVTNVARALGEQLSPPPPSDGAGAAAQAVWPYVIHGHYADAAEVAALLASALNVPMVMTGHSLGRNKLEQLLKLGRMPRAEIQGTYKIARRIEAEETGLDAADMVVTSTKQEIEEQWGLYDGFDLKVERKLRVRRRRGVSCLGRYMPRMVVIPPGMDFSYVDTQDLAADGAGGAGDAADLQLLINPNKAKKPLPPIWSEVLRFFTNPHKPMILALSRPDPKKNVTTLLKAYGESRHLRELANLTLILGNRDDIEEMSGGAATVLTAVLKLIDRYDLYGQVAYPKHHKQTDVPHIYRLAAKTKGVFINPALVEPFGLTIIEAAAYGLPVVATKNGGPVDILKVLSNGLLVDPHDAAAITAALLSLLADKSRWSECRRSGLRNIHRFSWPHHCRLYLSHVAASCDHPAPHQLLRVPPSPSSSSAAAAAAGGGGAAASSEPLSDSLRDLSLRISVDAASPDLSAGDSAAAILDALRRRRSTDRPAASSAARAIGFAPGRRQSLLVVAIDCYGDDGKPNVEQLKKVVELAMSAGDGDDAGGRGYVLSTGMTIPEAVDALRACGADPAGFDALICSSGAEICYPWKGEQLAADEEYAGHVAFRWPGDHVRSAVPRLGKADGAQEADLAVDAAACSVHCHAYAAKDASKVKKVDWIRQALRMRGFRCNLVYTRACTRLNVVPLSASRPRALRYLSIQWGIDLSKVAVLVGEKGDTDRERLLPGLHRTVILPGMVAAGSEELLRDEDGFTTEDVVAMDSPNIVTLADGQDIAAAAADLLKAI

SEQ ID NO: 8955 - protein, 855 aa, Oryza sativa
MASKLSFKRMDSIAETMPDALRQSRYQMKRCFQRYVSKGKRLLKNQQLMEELEKSLDDKVENEKLVEGFLGYIICSTQEAVVLPPFVAFAVRMNPGIWEYVKVHSDDLSVEGITPSEYLKFKETLYDEKWAKDDNSLEVDFGALDLSTPHLTLPSSIGNGLQFVSKFMSSKLGGKPESMKPLLDYLLTLNYRGEKLMINDTIDTVSKLQTALLLAEVFVSGLPKYTPYLKFEQRFQEWGLEKGWGDTAERCKETLNCLSEVLQAPDPTNMEKFFSRVPSIFNIVIFSIHGYFGQEKVLGLPDTGGQVVYILDQVRAMEEELLQRIKQQGLHVTPKILVLTRLIPDAKGTKCNVELEPVENTKYSHILRVPFKTEDGKDLRQWVSRFDIYPYLERYAQNSCAKILDILEGKPDLIIGNYTDGNLVASLLSNKLCVTQGTIAHALEKTKYEDSDVKWREMDQKYHFSCQFTADMISMNTSDFIITSTYQEIAGSKEKPGQYEHHYAFTMPGLCRYATGINVFDPKFNIAAPGADQSIYFPFTQKQKRLTDLHPQIDELLYSKDDTDEHIGYLADRNKPIIFSMARLDKVKNITGLVEWYGQNKKLRDLVNLVVVAGLLDASQSKDREEIEEINKMHNLMDRYQLKGQIRWIKAQTDRVRNGELYRCIADTKGAFVQPALYEAFGLTVIEAMNCGLPTFATNQGGPAEIIIDGVSGFHVNPINGREAGIKIADFFQKCKEDPSYWNKVSTAGLQRIYECYTWKIYATRVLNMGSTYSFWKTLNKEERQAKQRYLQIFYNVQYRNLAKAVARAGDQQARQTTTGVAPSEIVVRPKERKPQTRMQRILTRLAGQKPPVSE

SEQ ID NO: 8956 - protein, 1066 aa, Oryza sativa
MAGNDWINSYLEAILDAGGAAGEISAAAGGGGDGAAATGEKRDKSSLMLRERGRFSPARYFVEEVISGFDETDLYKTWVRTAAMRSPQERNTRLENMSWRIWNLARKKKQIEGEEASRLAKQRLEREKARRYAAADMSEDLSEGEKGENINESSSTHDESTRGRMPRIGSTDAIEAWASQHKDKKLYIVLISIHGLIRGENMELGRDSDTGGQVKYVVELARALGSTPGVYRVDLLTRQISAPDVDWSYGEPTEMLSPRNSENFGHDMGESSGAYIVRIPFGPRDKYIPKEHLWPHIQEFVDGALVHIMQMSKVLGEQVGSGQLVWPVVIHGHYADAGDSAALLSGALNVPMIFTGHSLGRDKLEQLLKQGRQTRDEINTIYKIMRRIEAEELCLDASEIIITSTRQEIEQQWGLYDGFDLTMARKLRARIKRGVSCYGRYMPRMIAVPPGMEFSHIVPHDVDQDGEEANEDGSGSTDPPIWADIMRFFSNPRKPMILALARPDPKKNITTLVKAFGEHRELRNLANLTLIMGNRDVIDEMSSTNSAVLTSILKLIDKYDLYGQVAYPKHHKQSEVPDIYRLAARTKGVFINCAFIEPFGLTLIEAAAYGLPMVATRNGGPVDIHRVLDNGILVDPHNQNEIAEALYKLVSDKQLWAQCRQNGLKNIHQFSWPEHCKNYLSRVGTLKPRHPRWQKSDDATEVSEADSPGDSLRDVHDISLNLKLSLDSEKSSTKENSVRRNLEDAVQKLSRGVSANRKTESVENMEATTGNKWPSLRRRKHIVVIAIDSVQDANLVEIIKNIFVASSNERLSGSVGFVLSTSRAISEVHSLLTSGGIEATDFDAFICNSGSDLCYPSSNSEDMLSPAELPFMIDLDYHTQIEYRWGGEGLRKTLICWAAEKSEGGQVVLVEDEECSSTYCISFRVKNAEAVPPVKELRKTMRIQALRCHVLYSHDGSKLNVIPVLASRSQALRYLYIRWGVELSNMTVVVGESGDTDYEGLLGGVHKTIILKGSFNAVPNQVHAARSYSLQDVISFDKPGITSIEGYGPDNLKSALQQFGILKDNV

SEQ ID NO: 8957 - protein, 1056 aa, Spinacia oleracea
MAGNDWINSYLEAILDVGGQGIDASTGKTSTAPPSLLLRERGHFSPSRYFVEEVISGFDETDLHRSWVRAASTRSPQERNTRLENLCWRIWNLARKKKQIEGEEAQRLAKRHVERERGRREATADMSEDLSEGERGDTVADMLFASESTKGRMRRISSVEMMDNWANTFKEKKLYVVLISLHGLIRGENMELGRDSDTGGQVKYVVELARALGSMPGVYRVDLLTRQVSAPGVDWSYGEPTEMLSSRNSENSTEQLGESSGAYIIRIPFGPKDKYVAKELLWPYIPEFVDGALSHIKQMSKVLGEQIGGGLPVWPASVHGHYADAGDSAALLSGALNVPMVFTGHSLGRDKLDQLLKQGRLSREEVDATYKIMRRIEAEELCLDASEIVITSTRQEIEEQWQLYHGFDLVLERKLRARMRRGVSCHGRFMPRMAKIPPGMEFNHIAPEDADMDTDIDGHKESNANPDPVIWSEIMRFFSNGRKPMILALARPDPKKNLTTLVKAFGECRPLRELANLTLIIGNRDDIDEMSTTSSSVLISILKLIDKYDLYGQVAYPKHHKQSDVPDIYRLAAKTKGVFINPAFIEPFGLTLIEAAAYGLPIVATKNGGPVDIIGVLDNGLLIDPHDQKSIADALLKLVADKHLWTKCRQNGLKNIHLFSWPEHCKNYLSRIASCKPRQPNWQRIDEGSENSDTDSAGDSLRDIQDISLNLKLSLDAERTEGGNSFDDSLDSEEANAKRKIENAVAKLSKSMDKAQVDVGNLKFPAIRRRKCIFVIALDCDVTSDLLQVIKTVISIVGEQRPTGSIGFILSTSMTLSEVDSLLDSGGLRPADFDAFICNSGSELYYPSTDYSESPFVLDQDYYSHIDYRWGGEGLWKTLVKWAASVNEKKGENAPNIVIADETSSTTHCYAFKVNDFTLAPPAKELRKMMRIQALRCHAIYCQNGTRLNVIPVLASRSQALRYLFMRWGVELSNFVVFVGESGDTDYEGLLGGVHKTVILKGIGSNTSNFHATRAYPMEHVMPVDSPNMFQTGGCNIDDISDALSKIGCLKAQKSL

SEQ ID NO: 8958 - protein, 805 aa, Nostoc sp.
MHELFHPIFANGEEKAALQQLIIALDASGKRYFLRNEILHTFSQYCQQAQKPTYFYYSSSVGKLIQYTHEIVLAEDGTWFVVRPRIASQEVWRLTSDLAKFDSMSIDAFLDVSDRLVNAYEPNILEIDLNSFYEASPSISDPRNIGQGLAFLNRYLCSQIATDPQYWVELVYLALRGLQYDGINLMIGDAIPSGIHLAKQIHAAIKFLSALPPEEPYEKFYIELQKLGFEPGWGNTAQRILETITLLDKLIDSPQPAVLEAFVARVPAVFRVVLVSIHGWVAQEDVMGRDETLGQVIYVLEQARSLENKLQQEIKLAGLEVLGIQPHVIILTRLIPNCEGTYCNLRLEKLHNTENAWILRVPFGEFNPEITNNWISKFEIWPYLETFALDAEKQLLAQFQGKPNLIIGNYSDGNLVAFLLARRLKVTHCNIAHSLEKPKNLFSNLYWQDSEEKYHFSVQFTADLITMNAADFIITSSYQEIFGTPESIGQYESYKFFTMPHLYHVVDGIDLFNPKFNMVPPGVNEQVFFPYSQTADRDPNVSKHVHDLLFHRQDSQIFGYLDQPQKPPIFAVAPITSIKNLTGLAECFGRSQELQAHSNLILLTSKLNIDESTNPEEAREIEKLHNIINQYQLHGHIRWLGLRLPNQEVGEAYRLVADYRGIYIHFARFEAFGRSILEAMISGLPTFATKFGGSLEIMEDQNNGFRINPTDLEGTAEKILAFFQECDTHPEHWQEVSQWMSQRIHQKYNWQLHTSQLLALTKIYSFWNFIRPESSEARVRYMESLFHLIYKPRAEQILAKHMSCH

SEQ ID NO: 8959 - protein, 808 aa, Arabidopsis thaliana
MANAERVITRVHSQRERLDATLVAQKNEVFALLSRVEAKGKGILQHHQIIAEFEAMPLETQKKLKGGAFFEFLRSAQEAIVLPPFVALAVRPRPGVWEYVRVNLHDLVVEELQASEYLQFKEELVDGIKNGNFTLELDFEPFNAAFPRPTLNKYIGDGVEFLNRHLSAKLFHDKESLHPLLKFLRLHSHEGKTLMLNNRIQNLNTLQHNLRKAEEYLMELKPETLYSEFEHKFQEIGLERGWGDTAERVLNMIRLLLDLLEAPDPCTLENFLGRIPMVFNVVILSPHGYFAQDNVLGYPDTGGQVVYILDQVRALETEMLQRIKQQGLNITPRILIITRLLPDAAGTTCGQRLEKVYGSQYCDILRVPFRTEKGIVRKWISRFEVWPYLETFTEDVAAEISKELQGKPDLIIGNYSDGNLVASLLAHKLGVTQCTIAHALEKTKYPDSDIYWKKLDEKYHFSCQFTADLIAMNHTDFIITSTFQEIAGSKDTVGQYESHRSFTLPGLYRVVHGIDVFDPKFNIVSPGADMSIYFAYTEEKRRLTAFHLEIEELLYSDVENEEHLCVLKDKKKPIIFTMARLDRVKNLSGLVEWYGKNTRLRELVNLVVVGGDRRKESQDNEEKAEMKKMYELIEEYKLNGQFRWISSQMNRVRNGELYRYICDTKGAFVQPALYEAFGLTVVEAMTCGLPTFATCNGGPAEIIVHGKSGFHIDPYHGDKAAESLADFFTKCKHDPSHWDQISLGGLERIQEKYTWQIYSQRLLTLTGVYGFWKHVSNLDRLESRRYLEMFYALKYRPLAQAVPLAHEE

SEQ ID NO: 8960 - protein, 816 aa, Oryza sativa
MGETTGERALTRLHSMRERIGDSLSAHTNELVAVFSRLVNQGKGMLQPHQIIAEYNAAIPEGEREKLKDSALEDVLRGAQEAIVIPPWIALAIRPRPGVWEYLRINVSQLGVEELSVPEYLQFKEQLVDGSTQNNFVLELDFEPFNASFPRPSLSKSIGNGVQFLNRHLSSKLFHDKESMYPLLNFLRAHNYKGMTMMLNDRIRSLDALQGALRKAEKHLAGITADTPYSEFHHRFQELGLEKGWGDCAQRVRETIHLLLDLLEAPEPSALEKFLGTIPMVFNVVILSPHGYFAQANVLGYPDTGGQVVYILDQVRAMENEMLLRIKQQGLNITPRILIVTRLLPDAHGTTCGQRLEKVLGTEHTHILRVPFRTENGTVRKWISRFEVWPYLETYTDDVAHEISGELQATPDLIIGNYSDGNLVACLLAHKLGVTHCTIAHALEKTKYPNSDLYWKKFEDHYHFSCQFTADLIAMNHADFIITSTFQEIAGNKETVGQYESHMAFTMPGLYRVVHGIDVFDPKFNIVSPGADMSIYFPFTESQKRLTSLHLEIEELLFSDVENTEHKFVLKDKKKPIIFSMARLDHVKNLTGLVELYGRNPRLQELVNLVVVCGDHGKESKDKEEQAEFKKMFNLIEQYNLNGHIRWISAQMNRVRNGELYRYICDMRGAFVQPALYEAFGLTVIEAMTCGLPTFATAYGGPAEIIVHGVSGYHIDPYQNDKASALLVEFFEKCQEDPNHWIKISQGGLQRIEEKYTWKLYSERLMTLSGVYGFWKYVTNLDRRETRRYLEMLYALKYRKMATTVPLAIEGEASTK

SEQ ID NO: 8961 - protein, 816 aa, Unknown
  Description of Unknown: Oryza sativa Japonica Group sequence
MGEAAGDRVLSRLHSVRERIGDSLSAHPNELVAVFTRLVNLGKGMLQAHQIIAEYNNAISEADREKLKDGAFEDVLRSAQEGIVISPWVALAIRPRPGVWEYVRVNVSELAVELLTVPEYLQFKEQLVEEGTNNNFVLELDFEPFNASFPRPSLSKSIGNGVQFLNRHLSSKLFHDKESMYPLLNFLRAHNYKGMTMMLNDRIRSLSALQGALRKAEEHLSGLSADTPYSEFHHRFQELGLEKGWGDCAKRSQETIHLLLDLLEAPDPSTLEKFLGTIPMVFNVVIMSPHGYFAQANVLGYPDTGGQVVYILDQVRAMENEMLLRIKQQGLNITPRILIVTRLLPDATGTTCGQRLEKVLGTEHTHILRVPFRTENGIVRKWISRFEVWPYLETFTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADMSIYFPYSESRKRLTSLHPEIEELLYSEVDNNEHKFMLKDRNKPIIFSMARLDRVKNLTGLVELYGRNPRLQELVNLVVVCGDHGNPSKDKEEQAEFKKMFDLIEQYNLNGHIRWISAQMNRVRNGELYRYICDTKGAFVQPAFYEAFGLTVVESMTCGLPTFATAYGGPAEIIVNGVSGFHIDPYQGDKASALLVEFFEKCQEDPSHWTKISQGGLQRIEEKYTWKLYSERLMTLTGVYGFWKYVSNLERRETRRYLEMLYALKYRTMASTVPLAVEGEPSNK

SEQ ID NO: 8962 - protein, 600 aa, Chlorella variabilis
MPALETVFEDLVGTPVSERTPHGPLENRFDRLYVILISLHGLVRGDRMELGRDSDTGGQVKYVVELAKALALHPSVYRVDLLTRLIQDPAVDASYGQPQECLVKGRGELGGAYIVRLPCGPPQQYVRKELLWPYVREFADRGIAHANATLAAMAESGRRCELYAVHGHYADAGEVAVLMSSSLDVHMVMTGHSLGRNKLEHLLASGAMTRSEIEAAYAISRRIEAEERCLDNAVMVFTSTKQEVDEQWGLYDGYSPQLSRVLRFHRSYGRHMPNMKVIPPGLDFSSLKVSMPEDPTLREFEQARAVQDLLEKPQPLSPRATATSGATSPRRLEAGQEVEPAAGGAGAGGTAPHTPSIASGGAAGQQSPRGDSSSGAADPPTPRPAADMALDPHAGPPIWREISRYLRNPLKPAILAMSRPDPKKNLTTLVEAFGKHAMLRELANLVLIMGNRDNIDSMASGSQKVLTQVLKLIDSHDLYGSVAYPKHHTQMDISDIYLFAFATRGVFVNIALQEPFGLTVIEAAAHGVPTVATKNGGPVDIMATLHHGVVVDPTNPDAVAAALLRILTNPQTWDDMSGSGIRNIMAYSWPSHCKKYLESI

SEQ ID NO: 8963 - protein, 805 aa, Beta vulgaris
MASRLTRVPSLKERLDETLTAQRNEIISFLSKIASHGKGILQPHEVLSEFEAVADKHKLADGPFGEVLRHTQETIVLPPWITLAVRPRPGIWEYIRVNVDALAVEELTPSQFLHVKEELVDGSTNGNFVLELDFEPFTASFPRPTLSKSIGNGVEFLNRHLSAKMFHDKESMRPLLDFLRMHHYKGKTIMLNDRIQNLDSLQAVLRKAEEFLTTIPADTPYSEFDHKFQEIGLERGWGDNAERVMDMIQLLLDLLEAPDSCTLEKFLGRIPMVFNVVILTPHGYFAQANVLGYPDTGGQVVYILDQVRALEHEMLLRIKQQGLDIIPRILIVSRLLPDAVGTTCGQRLEKVFGTEHSHILRVPFRTEKGIVRRWISRFEVWPYLETYTEDVANEIAGELQAKPDLIIGNYSDGNIVASLLAHKLGVTQCTIAHALEKTKYPNSDIYWKSFEEKYHFSCQFTADLIAMNHTDFIITSTFQEIAGNKDTVGQYESHMAFTLPGLYRVVHGIDVFDPKFNIVSPGADLSIYFNYTEEKKRLTALHPEIEELLFSETQNEEHICVLKDRKKPIIFSMARLDRVKNMTGLVEWYGKNKKLRELVNLVVVAGDRRKESKDTEEKEEMKKMYSLIEEYNLNGQFRWISAQMNRVRNGELYRYIADTRGAFVQPAYYEAFGLTVVEAMTCGLPTFATCHGGPAEIIVHGKSGFHIDPYHGDKAADLLVDFFEKSTADPSYWENISKGGLQRIEEKYTWKIYSDRLLTLAGVYGFWKYVSNLDRREARRYLEMFYALKYKKLAESVPLAIEDAN

SEQ ID NO: 8964 - protein, 677 aa, Anabaena sp.
FGPFYDYTPTIRDPKNIGKGVQYLNRYLSSKLFQDSQQWLESLFNFLRLHNYNGIQLLINHQIQSQQQLSQQVKNALNFVSDRPNDEPYEQFRLQLQTMGFEPGWGNTASRVRDTLNILDELIDSPDPQTLEAFISRIPMIFRIVLVSAHGWFGQEGVLGRPDTGGQVVYVLDQAKNLEKQLQEDAILAGLEVLNVQPKVIILTRLIPNSDGTLCNQRLEKVYGTENAWILRVPLREFNPKMTQNWISRFEFWPYLETFAIDSERELLAEFQGRPDLIVGNYTDGNLVAFLLTRRMKVTQCNIAHALEKSKYLFSNLYWQDLEEKYHFSLQFTADLIAMNAANFVISSTYQEIVGTPDSIGQYESYKCFTMPELYHVVNGIELFSPKFNVVPPGVNENSYFPYTQTQNRIESDRDRLEEMLFTLEDSSQIFGKLDDPNKRPIFSMARLDRIKNLTGLAECFGQSQELQERCNLILVAGKLRIEESEDNEEKDEIVKLYRIIDEYNLHGKIRWLGVRLSKNDSGEIYRVICDRQGIFVQPALFEAFGLTILESMISGLPTFATQFGGPLEIIQDKINGFYINPTHLEETATKILDFVTKCEQNPNYWNIISEKAIDRVYSTYTWKIHTTKLLTLARIYGFWNFTSKEKREDLLRYLESLFYLIYKPRAQQLLEQHKYR

SEQ ID NO: 8965 - protein, 1054 aa, Craterostigma plantagineum
MAGNDWINSYLEAILDVGPGIDEAKGSLLLRERGRFSPTRYFVEEVVSGFDETDLHRSWIRAQATRSPQERNTRLENMCWRIWNLARQKKQLENEEAQRMAKRRLERERGRREAVADMSEDLSEGEKGDIVVDHSHHGESNRGRLPRINSVDTMEAWMNQQKGKKLYIVLISLHGLIRGENMELGRDSDTGGQVKYVVELARALGSMPGVYRVDLLTRQVSSPEVDWSYGEPTEMLPPRNSENMMDEMGESSGSYIVRIPFGPKDKYVAKELLWPHIPEFVDGALGHIIQMSKVLGEQIGNGHPIWPAAIHGHYADAGDSAALLSGALNVPMLFTGHSLGRDKLEQLLRQGRLSRDEINSTYKIMRRIEAEELSLDASEMVITSTRQEIEEQWRLYDGFDPILERKLRARIKRNVSCYGRFMPRMMVIPPGMEFHHIVPHDGDLDAEPEFNEDSKSPDPHIWTEIMRFFSNPRKPMILALARPDPKKNLTTLVKAFGECKPLRELANLTLIMGNRDNIDEMSGTNASVLLSILKMIDKYDLYGLVAYPKHHKQSDVPDIYRLAAKTKGVFINPAFIEPFGLTLIEAAAHGLPIVATKNGGPVDIHRVLDNGILVDPHNQESIADALLKLVAEKHLWAKCRANGLKNIHLFSWPEHCKSYLSKLASCKPRQPRWLRNEEDDDENSESDSPSDSLRDIQDISLNLKFSFDGDKNESREKGGGSHPDDRASKIENAVLEWSKGVAKGPQRSMSIEKGEHNSNAGKFPALRRRKIMFVIAVDCKPSAGLSESVRKVFAAVENERAEGSVGFILATSFNISEIRHFLVSEKLNPTDFDAFICNSGGDLYYSSHHSEDNPFVVDLYYHSQIEYRWGGEGLRKTLVRWAASITDKKGEKEEHVIIEDEETSADYCYSFKVQKPNVVPPVKEARKVMRIQALRCHVVYCQNGNKINVIPVLASRAQALRYLYLRWGMELSKTVVVVGESGDTDYEEMLGGVHKTVVLSGVCTTATNLLHANRSYPLADVVCFDDLNIFKTHNEECSSTDLRALLEEHGAFKA

SEQ ID NO: 8966 - protein, 450 aa, Dongia sp.
MKVLVASTPASGHIDPMFSLARILVGAGHQVAGLSATAFRARIESAGAKFFPFPDRADFDLRDISIAFPAYKTISPGIEMSRFYLEKVFIDAIPAQVEGLREALRVFSADVILGDDFFLGALPILLGPRSERPAVVLCGTTFLHYRRDDGAPNFVGLPPATSRADLEAYAAIAEEHEELLYAPTRRYFNACLAALDVGPLAMDPHEAVITLPDAYLQLTVPSFEFPRRNLPRSVRFVGTPPLVPGQASIPEWAAELDGSRKVVLVTQGTLSNLDLGQLIVPTMAALAEEPDLLVVVTGGGRSSSALPGPIPSNVRFASYLPFEWLLPKTDLLVTNGGYGSLNQALSFGIPIVSAGLSEDKADVNARVAWSGVGIDLKAQQPSESALHQAIRRVLDLPNYRQRALAVSEEFARLDGRSRILSILERASAGSETQSAERAPIECRRYSGWVE

SEQ ID NO: 8967 - protein, 391 aa, Streptomyces sp.
MSRRPAHIAMIGVPAVSHVLPSLAVVRELVARGHRVTYANDPAVADLIKATGAEFVPVTSVLPVADNNWPDDPIAAMGLFLDDAVQSLPQVRAVYDADPADLYLYDIGAYAARALAESQGRPLVQLSPTFVAWEGYAEEVAAPLWQLPGADEYRARFGRWLARCGATTTDVETFCGPPSRSLALIPRAMQPYADKVDTGTVTFVGPCFGPRGDEDTWTRPAGARRVLLVSLGSAYTRQPEFYRNCLAAFGELPGWHVVLQIGRHTDPRELGTVPPGVDVRTWVPQVAVLAEADAFVTHAGMGSSGEGLSAGVPMIAVPQGAEQFMNADRLVELGVARRIDTADASAEALRTALLELVDDPDVARRSAELRARARAEGGTARAADLVEDALG

SEQ ID NO: 8968 - protein, 436 aa, Unknown
  Description of Unknown: Mycolicibacterium vanbaalenii PYR-1 sequence
MPEILIATCPPVGHLSPLLNVARGLVARGDRVTVLTSARHADKIRAVGAEPRPLPHAADYDDSTLDADLPGRAATAGLARINFDIESIFVRPLPHQFSALQELLVTDRFDAVIADALFLGTLPLLLGDPAKRPPILSYSTTPLFLTSRDTAPAGPGIAPMPGMIGRLRNRVLARATQSVLLRPGQRAADRMLEAMGLPELPVFILDSAVLADRVIVPTVPEFEYRRSDLPSHVRFVGPVSPLPGSDFVAPPWWGELNAGRPVVHVTQGTIDNADLTRLIEPTIEALADEDVTVVATTGGRPISQIRIPLPANTFVAKYVPHDVLLPMVDVMVTNGGYGAVQRALSDGVPVVVAGHTEDKPEVAARVRHFGVGIDLRTGTPTPTQVRRAVRKVLHEPGFRTKAGWLRSAYAAYDSVAEIAKLVDEAVAQRTQPLQSA

SEQ ID NO: 8969 - protein, 387 aa, Micromonospora aurantiaca
MSTWGWRSHFYSLVPLGWALQAAGHEVRVASHPSMAATISAAGLAAVPLGADVDFAEAFAGRIGTVAPLAGSASAGAVVPAITADGGVVRFADAVLDDLVSFGRSWRPDLVLWEPFNLAAPVAAAALGVPGVLNLWGPDSSTTLRMDPDQVVGPLAARFGLRAADVPLDGVLTLDPVPPPMQVPTARPGRPVRFVPYNGPAVVPDWLRRPAGRPRVCVTAGTMMAAAGLHDRFDLGGVIRAVAELDVEVVVVVEPRQHEGLGPLPARVRLVDGPLAVRLVLPTCAALVQQGGAGTTMTALAYGVPQLVLPQVSDQHFNAERLAATGAGTSLTGEQATADAVRELVGELVGDGPRRRAATSMRDRVHAMPAPADLVPALAALARGGPI

SEQ ID NO: 8970 - protein, 402 aa, Streptomyces leeuwenhoekii
MRILCTTLGSPSHGRAQLPLLRALAEAGHQVAVATTDGLAHVFRDDDVEVNAVLPDVDPVGMLGPFLGELRDSADLSLSSPALMRMLMRALAGPGVKPHLDVLAPLARDFRPDLILRDGMDMGAVLTAELLEVPQLPTPSGFSNIIEPAEVLPTLNERRRELGLPQRDDPLSFVPHGRVDYVPPAFSFSRHLPPALSYRQTVDVERHGALPPWAAGLPTDRPLVYAGIGTALPVMREQTAQGAPQLPVELPDAAESLEAIVGAAAELEECTVIVSTSGIPLDTAGLPGHVHVTERVPQPLLLESMDLFVTHGGFNSVREALRTGTPLAVLPHFGDQHTNAERVAELGLGGHITDRSARGIAKMCRALLADPAPRARARSAQLAMLTLPDIGQAVSDLEGIAG

SEQ ID NO: 8971 - protein, 374 aa, Escherichia coli
MRKRILFIGPPLYGLLYPLISLAQAFRVIGHDVVISSAGKFANKAAEAGLVVFDAVPGLDSEAGYRHQEELRKKSNIIGHFSFFSDEMADNLIDFAGKWRPDLIVYPPLDPAGPLVAAKYRIPSVMLAVGFAHTSAHIQMLNRSLSNAYRRHGVSGPLCDLAWIDVAPPSMSILKNAGEPVISMRYIPYNGGAVKETWWDRDSDRKRLLISLGTVKPMVDGLELISWVMDSANEVDADIILQLAINARTGLRKLPSNVRLVDWIPMGVFLNGADGFIHHGGAGNTLTALYSGIPQIVFGEGADRSVNAEIVAKRGCGIIPDKHGLTSDLVNRLLYDDSLRFCSDQVAAEMAEQPSPAEIAEVLMRKLKNNGKQL

SEQ ID NO: 8972 - protein, 392 aa, Unknown
  Description of Unknown: Actinobacteria bacterium OV450 sequence
MSHDALRSHIAVFNVSMAGHVLPTLAVVRQLVLRGHRVSYAVTAEFGDQVRAVGAAPVLYDVPSAGEAPEDLAVGAAQAVEVNRAAVPQLEPAFADDRPDLVLYDVYAWAGPMLAARWGVPAVLLSPTHLPYDGVLSEMFGVDDLTRMPGFADLERAFTGYGVPGGARTVTLAPPHAIAFLPRTFQRRPETVRAAEAHWVGPALGDRSFQGNWRAPDNGWPVVYVSLGSQYNHRPEFYRMCAEAFTGLGVHVVMSVGAEVAQAGIGELPEGFEVHAAVPQLDVLAACSVFVTHGGMGSIMEAVALGVPLVVVPQMAEQRVNAECVQALGLGVHLPREQATGEALRDAVRTVRDDPHVRAALATLGQEVSQAGGSSAAADIVEKLLANRPMTS

SEQ ID NO: 8973 - protein, 370 aa, Klebsiella pneumoniae
MRILFIGPPLYGLLYPVISLAQAFRVNGHEVVVASAGKFTHKAADAGLVVFDAAPGLDSEAGYRHQEELRKKSNTVGHFSFFSDEMADRLVDFAGQWHPDLIVYPPLGLAGPLIAAKYGIPSVMQTVGFAHTSAHIQMVTRSLGNAYRRHGVSGPPRDLAWIDVTPPSMSILKNDGEPVISMRYVPYNGGAVREPWWDRAPGRKRLLISLGTVKPMVDGLDLISWVMDSANEVEADIILQLAMNARAGLRKLPSNVRLVEWIPMGVFLNGADGFIHHGGAGNTLTALYNGIPQIVFGEGADRPVNAKAVAERGCGIIPGDHGLTSDLVNTFLYDDSLRLCSAQVAAEMAEQPSPAEIAGVLVAKLKTIWQ

SEQ ID NO: 8974 - protein, 397 aa, Haliangium ochraceum
MTRILIVTLPERGHYHPLLGPAEELSRRGAEVVFACSHDIGDDLADVGVERFVAPPGAAPLSDELRGAELARLLADPEALRGWIRDMLAIGPARHVEPMRAIVRELRPDVVAIDAMAYEGAIAAELEGVPWVGWATSLNPAIPAWLDSELIRTLRALDPVRHALFAEFGLRARFRVSDVLSPRGTAVFATDALIAPTRAGEPVDDDVHLVGPSLGGRRSHASPDLGFADGRPLIYASFGSQAWHQPQRFERLFEAARTLDAALLVAAGDLAAEYAAQNLPAHVRCVPFAPQLEVLAHARALVTHGGANSVMEALAAGVPLLVAPLCNDQPHNRLFVERAGAGLGIDLDTCAQDALLSALRALLADGRERTAAQRIAASYAASDGARGAAELALRCCP

SEQ ID NO: 8975 - protein, 391 aa, Klebsiella pneumoniae
MRILFIGPPLYGLLYPVLSLAQAFRVNGHEVLIASGGKFVKKAAEAGLVAFDAAPGLDSEAGYCRHEALRKESHIGTKMGNFSFFSEEMADHLVEFAGHWRPDLIIYPPLGVIGPLIAAKYDIPVVMQTVGFGHTPWHIKGVTRSLADTYHRHGVGAAPRDMAWIDVAPPSMSILENDGEPIIPMQYVPYNGGAVWEPWWERKPDRKRLLVSLGTVKPMVDGLELITWVMDSASEVDAEIILHLSANARSDLRSLPSNVRLVDWIPMGAFLNGADGFIHHGGAGNTLTALHAGIPQIVFGQGADRPVNARVVVERGCGIIPGDGGLSSNMINAFLDNRALRDASEDVECKDKSDNCGLSKILPTSERITPAIKHGNALNDITETLQHLFLH

SEQ ID NO: 8976 - protein, 377 aa, Kribbella flavida
MRVLFTFIGGSGHFRPLVAVARAVEAAGHTVAVAGSGKVTPVVEAAGFVAFPTSGPRVADAPPAAPEPLVAVDPAAEERHFAAAFGRSGARRHAAALLELAGEWRPDVIVRDEADFGSAIAAERLGIPCATVLVLAAGSLVRKELLAEPLGQLRAEYGLPPDPGLAMLDRELVLSPFPPSFRSPDFPLPQTAFSYRTADVVPIAAVRETPTVYFTLGTVFRPDTDDLFSRVLAGLREVPAKVVVTVGERNDPAALGPQPGHVRVERFVPQEELLPYCDLVVSHGGSGSLLGALAHGLPSVLLPLGADQPHNAQRCLELGLGRVLDAVTVGPDEVAATVTEVLADQDHRRAAQRIQTEINGLPDVTRTVALLEASGRR

SEQ ID NO: 8977 - protein, 404 aa, Streptomyces violaceusniger
MFTTLGSPSHGRAQLPLARSLAAAGHEVLVVTTPALAFVFEREEVRVTTAIGDFSPSAFLGTVLAEENPQGGPPEMDGKELQAHMLRLMTKAISGPMATMLLDTLLPVAHDFRPDLILRDGMDLASCVIAEALGIPQLSTPSGASNTFDPAGILPGLNALRKRQGLATFEDPLSLIPHGRIDYVPPAFSFARHLPASWSYRQTVDVDRGAALPRWVAELPTDRPLVFAAIGTAIPMFHGNNEGDVPASPLPVPDPVDTLHAMIQGLSGLQECTVVLATSGIPVDTDGLPAHVHITKRLPQPLLLESVDLFLTHGGFNSIRESMRTATPMAVLPQFGDQPGNAQRVEELGLGRHITDPTPDGITTVCRELLADDDCRAVARRARLEMLALPEIDSAVADLEKIAG

SEQ ID NO: 8978 - protein, 391 aa, Unknown
  Description of Unknown: Actinobacteria bacterium OV320 sequence
MSRFLFVVPPLVGHLNPAVGVAAELTARGHRVAWACADPELVGRLAGPAAGAVFACGGAPPGERPADLRGPQALKFLWEWYLLPLAEAMAPGVRAAVEAFRPDVVVADQQAFAGALVAERLGLPWATSATTSAEFTDPLAGLPKVREWLDGRLAALRSAIGDPAGDADPRFSPHLVLAFSTPELAGNAHGGVRWVGPSITARPSAAGFPWEWLDGGRATVLVTLGTANTDVGGRFLEVCREVLRERADRVQGVIVDPGGTLQPRGDDKDVLILPSVPQLALLGRLERGSGAVVCHAGHNSVCEALWHGVPLVVAPIRDDQPVVAGQVTDAGAGVRVRFGRVGARQLGAAVDSVLDEPGHRAAAARIRTAFRAAGGSSAAAAHLEDLAREFR

SEQ ID NO: 8979 - protein, 402 aa, Actinosynnema mirum
MRVLFTVTGAPSHAHEMLVLGRAVLDAGHEVLVATAPSAAPGLRGSGLPSVEALPDQARFWVERLGGVVPPARPGTDYPGVDAIVDVIAGRPLLREALAGLRPVVDRFRPDLVLRDGMELAGLLVAEERGLPCLTVPSGTTNQLDPAAVLPRLNERRAEQDLPTSADPLSAHRHGHVDCLPREYSLLGVPLSPCLAYRPPSPEGRSLPAWLADLDPSRPLVYGAVGIALAATWRRDDVTALAADPVEALSGLVAALSEVDCAAVVSTGGIPVDRVPPGAPHVRVVERAPQPLLLECAQLFVTHAGANSVREAVRAGVPMVAAPLFGDQPHNAARVAALGLGVRVVDGSPADLVDACRTVLADPGFTARARHARRTVLALPPVGEVVTRLEQIAEAARSVAAV

SEQ ID NO: 8980 - protein, 387 aa, Conexibacter woesei
MRALLASTAGAGHVGPLLPFAAALARRGDDVLVVGPPGLEPAIAAAGHAFAAGADPPAQEVAEIWRRFESAPPPERSVLVNRELFGRLCTAAMLPALDRVCDEWRPDLVLREPCDFASAIAAERRAIPHAQVAISLAEVEAGSLALAAPVLDPHLPGIVERIHAAPYLTRFPRALDPSPFARTVRFRAGGAADRAGGEGAAESAGGPSAADGWRQAWPEDDERPLVYATLGSVAPTLALAAPVYRAIVDAVAELPVRVLLTVGRQPDPDTLGPLPPNVRAAAWVDQAGVLPGAAVVVCHGGSGTTFGALAAGVPLVLLPLFADQPVNARRVVEAGAGIAVAPPHAADDVRAAIEQLLSTPAHRDAAGAIAREMCAAPSVTDVLDQLV

SEQ ID NO: 8981 - protein, 443 aa, Acidovorax citrulli
MARYLLAATALPGHVMPVLAVARHLVQLGHEVRIHTGGIFRTQAENTGASFIPLLPGINHDYRELGQRHPQLQRLSPGPPRLAYGLKHFFADAIALQYEGLRSILDGGFDADAIVTDTMFCGTMPLLLGPRSDRPPVVALGISALALSSADTAMFGSALPPPANAQQRQQYQSLQAMVRRTTFDDVQRHFDGVLAQLGRPPLPGFFADAMFTLPDLYLQLTAEAFEYPRSDLPETVRFVGPLLAPPSQGFEPPPWWHTLDDGRNVVLVTQGTLANEDPNHLIVPTLQALAGMPHLHVIATTGGPVPAAVAAAAPANARVLDFVPYDRLLPKVHAMVTNGGYGSVNHALSLGIPLVVAGTTEEKPEIAARVAWTGAGINLKTGQPGRRAIADAIHQLLGNPSYRQRAQALRDAFAGYDALASIAQALENLPGPAERSRLQPALA

SEQ ID NO: 8982 - protein, 409 aa, Streptomyces angustmyceticus
MSGSRAVSQRHVAVFVFADFGHVNPTLGLTRELVARGHRVTYVVDHRYTELVERAGARAVGYTSRRGAFGKVPDPSAARLAAEGYELLVETMDTVCPLAVAALASDVPDLVLYDFESFAAARMTARILGCTTTVQLSPSHASNETFSMRAQLFDPEDPSMRQGGAALMRFTRDHGLAPDELGRFLAEWDDRNLAFLPREFQIEGASFDDRFAFVGPSVAEDGAAVPWTPPGDGRRLALVSLGTESNRQRDFFRTCLDAFDGDDWHVVMTLGRGSDLAGLGPVPPHVEVHEWLPHPVVLPHADLLVCHAGMGSVMEALYFGTPVIAVPQTFELALTARRLDDLKLGRWIDRDQLTSQTLAAAVTEIVTDPGTPERMARMRAQVRGAGGAVRAADLLEQWAADRAPSVSGV

SEQ ID NO: 8983 - protein, 412 aa, Unknown
  Description of Unknown: Mycolicibacterium gilvum PYR-GCK sequence
MPMVDVGAGLQSLGHEVTILTAAEYADLVEAAGLQMLCLPGSVVIDPPAAAPVVMRRMPPAVRRFWLGRAELDAIFAKPLAAEAESLTSALAATTYDAVVADVTFTGVLPMLLRDDARPPVVVCGVGPLTISSTDTPPFGMAWQPEAGVDYTQMTAVAHRVIMRASQRRFDRALRRAGCGRSPVFISDWPRLADGILQLSVRDFEYPRSDLPATVEYVGPVLPDGTAGFVPPPWWREIERDGTTVVHVTQGTFDNTDLNQLIGPTFEALEDLDDVLVVATTGGRAGQRIADRIPSNVLVAEWIPYSALLPNVDVMITNGGYGGVQYALGHGVPLIVAGETSDKAEVAARVAYTGVGIDLGTSSPSAAAIRAAVDAVRRDDRYREAAGKLRTVIEASTPIDAIASVLKRCADA

SEQ ID NO: 8984 - protein, 399 aa, Streptomyces sp.
MTESPRAHIAMFSIAAHGHVNPSLDVIRELVDRGHRVSYAIPASFAEKAAAVGARPVIYASTLPTDDDPDAWGTELIDNIEPFLDDALQALPQLAEAFEGDEPDLVLHDITSYPARVLAHRWGVPAVSLWPNLVPWEGYEQEVGEPMTAELKQTERGRAYYARFDGWLAENGLGHVSSDDFVARPRFGIVLIPEALQPNADRVNRGMYTFVGACQGDRSDQGEWARPAGAEKVLLVSLGSSFTKQPAFYRECVAAFGGLPGWHVVLQIGAHVDPAELGEVPDNVEVSAWVPQLAVLKQADAFITHAGAGGSQEGLATGTPMVAVPQAVDQFGNADMLQSLGVARHLPMEDADAASLREAVLALVDDPEVAARCGLLSERMAREGGTRRAADLIEAELSR

SEQ ID NO: 8985 - protein, 380 aa, Kutzneria sp.
MRILITTSPGLGHILPTISFAHAARAAGHEVLYATGGSVDAVSDAGLQVVDASPGTDYREIFMGAGARMGEQMTAARNDLQRTVEVALRMFAKVSEPTLETVVRVAEKWQPDVIVHTPMQAAGQLAAGKLGVPLVMLNLGMGQDRGLSDMRKTTYEELHEYFERHGVAEAPAPAVRFDVTPPSVRGEAEQPADVWSMRYVPYNGGSVLPEWLLDKPDRRRVLITLGTVVPGFGLGMLEPIVAAASKVDAEFVLALGDVDISSLGELPDNVRPVGYLPLGMLLSSCDAAIHHGGAGTTMTTVDAGIPQIVVPQGADQFINADTVQASGLGQRAVVTDVDVALIERLLGDEQWQANARKIRSELHAMPSPVDVVDRLAGFVG

SEQ ID NO: 8986 - protein, 371 aa, Micromonospora sp.
MRVLFMPGPAIGHAFPLVPLGWAFRAAGHEVVFVTAGDALAVARAGLPVLDAVPGRTTSDMQAQFIRDVPRLFEPIGADPIAEMEERKPYIVSAWDPFVDAHVALGEWVQPDLVVYDPIFAVGPVVAARLKVPAVAHSLGLARFTPDLLRELPGAVAMRRHGVTLPEGIRTVDIAPPSLVEGGPADISMRYVPYNGGGVLPDWLREPVARPRIAVTFGTLGGPDRFAAGIARVLAAAPGLDAEFVLAIGESAAPPDLPPNVRTTGWVPLNQLLRGCAAAIHHGGDGTTLTCAALGVRQLVLPGSPDELVTGELLRGRGLAHVLGSVDELDAAAIGRLLTDAELGRVTGEVRAEIAALPSPAEVVPRLTAAV

SEQ ID NO: 8987 - protein, 383 aa, Saccharopolyspora erythraea
MRVLLSSLPAAGHLYPLVPFAWALRCAGHDVLVAAPSDLVPEATATGLPVAAVTDGPIGLRDLLERLRRLPWFGGDHAILGSLHDFATGADDRSPLTDLVEQTLPGTEALVRDWRPDVVLRDMADLTGVLACARTGVPFAEHWWGLAAPAPARGELRRIFGDLFARFEARTPPRRALTIDPVPPSFQSDDAPPVYRSRYVPYNGRAERPALPPRSQTPRICLSFGTLLTGDGVSGLAERVLDAAHRLGAEVVLAADEPPVESHPALLAAGRLPLDQVLASCDALVHHGGSGTMLTALCHGLPQLVFPHGSDHFVNADRLRSLHLAAVLNARDDPTRVERTLHAVLTDEGMRAGTRKIADEIAAQPAPADLVPLFEATVEDLAA

SEQ ID NO: 8988 - protein, 402 aa, Micromonospora aurantiaca
MKVLFTVSSWPTHYAVMVPIGWALQAGGHEVRVLCTPSQVAPLCAAGLTPVPILDSPSDEIRLRLQYFMEAVDGVWPYPWPPLHPITGAQLDGLDDFDLTGFRERQLPEVAARAAASFDAAVEYTTAFRPDFVLHDPASLEGLLAGLVTGVKTAMVLWGPVGPAEPEHMRIVPDDISGSFARYGLGPFDAGMIKTVVDPCPSSVEPPLAAERLPVRYVPYNGTAPAPTWLLEPIDRPRVCLSWSTALRSMSGPRSFVLPEAVRALEGLDAEVVLTATAQDVAELGPVPPTVRVLERLPLRLLLPTCSAVVHHGGGGSTLTSLWAGVPQVLLTFASEQAASATRVAAAGAAVQLPGHLVDAAAIRRAIDELLADGSYRRSAVRLRGEMEQRPTPADLVDLIGV

SEQ ID NO: 8989 - protein, 417 aa, Nocardiopsis dassonvillei
MRVLLAAAAEKPHFLGMVPLAWALRAAGHEVRVASQPALEPVAAGAGLPFTAVGRDHAFWRTMKAFDLHDTLDDVPLFGRVTDPYERVPWEYLLEGYRRVVPWWWRMVNDPMVDDLVALCREWRPELVVWGSVSFSGAIAAEACGAAHVRYLWGADIFARTRARFLARMGEQPASQREDPLAAWLGTRAARYGVDFSETLVHGQATVEQVPASLRVDTPAHLEYLPVRYVPYNGRAVVPHWLRTPPTRPRVCVTLGTTLMGQDRGGDVFRDLLEGLAELDVEVVATLPAREQAKLGTVPGNARLVEYVPLHALAPTCAAMVDHGGWGTVLTGLDAGVPQVIVPSWFDDPMLADMLAARDAAVSVPHRTMTAGDVSTAVSRLLEDPALARGTARVREAMRAMPSPADLADALVRRAGG

SEQ ID NO: 8990 - protein, 406 aa, Streptomyces violaceusniger
MTPSTGAKPPTHIAMFGIAAHGHVNPSLEVIRELVARGHRVTYAIPESFAEKVAETGAEPKTYTSVLHGENVPGATGSELIDYIEPFLAEAEQALPQHLAAYEGDEPDLVMYDVTAYPAHVLAHRWGVSAVELAPSFVPWDGYREEVFEPMYAQLRCSERGRAYYARYRAWLEDNGLAGTDPDRLIGRPSRCVALIPELLQPNADRVDPSVYSFVGGCQSARREVAEWRRPERAAQTDRILLVSLGSTWTKEPGFYRACVAAFGDLPGWYVVLQIGEFVDRADLGEIPANAEVHSWIPQLSILRKADAFVTHAGAGGAQEGLACGVPMVAVPQAVDQFSNADTLEALGVGRHLPKEEATASALRKAVLDLVDDPEVAARCAALKARMAAEGGPDRAADLIEAELPV

SEQ ID NO: 8991 - protein, 402 aa, Streptomyces afghaniensis
MRVLCTTLGSPSHGRAQLPLLRALAKAGHQVLVVTTEALVPVFRDDDVQVNAALPEFDPLAAMGPYLAELGDTPDLTEPTDALARLLMRNVAGPGVKPHLDVLLPLAQDFRPDVILRDGMDMGAVLTAELLGVPQLPTPSGFSNVLDPAEALPQLNERREELGLPVRDDPLSLVPHGRVDYVPPAFSFARHLPHTWAYRQTVDVERGMVLPEWAAELPTDRPLVYAAIGTALPKMHARTEDGETPLPVKLPDATESLHAIVRAAAELDDCTVVVSTSGLPVDTEGLPGHVHVAERVPQPLLLESVDLFITHGGFNSIREAMRTGTPLAVLPHFGDQPANAERVEELGLGRHIADRSAAGIADVCRKLLADPGPRARARSAQLAMLTLPDVEQAVDDLAGLAG

SEQ ID NO: 8992 - protein, 442 aa, Unknown
  Description of Unknown: Candidatus Solibacter usitatus Ellin6076 sequence
MSRFLITCWPFVGHLYPQISVALALRDRGHEVAFYSHESTRAIVQGEGFKLFPFVQVDERRYERIHALEAKVPPTQPGHQTISVSMTAYRDMLADSIPEQVADLMPILENWRPDVLVTDLALWGPIVVIWEMTGIPVALSSTMMGSMIPGPDAPPWGPGLPPPRTSATRFLSRITELGVDIVAHNLRRRVNQIRARYGLRPMGCSVTAFTGRLPLYLIPSLPELDYNRQDQPPNVHYIGPCVWTKPVGAPPPEWLNQLPTDRPWVHATEGTAQYQEPFLLRATAQALAGLPMEVILTTGQNRDPATLGLDPLPANVRVERWLSHESLLPRCAAIVTTGGPATVMAALKAGVPLVMVPTFWEKNDNAQRVVEAGVGLRLAPRRCSPDRVRAAVMRLLEEPHFRENARRIAQRLSEASGARGAAQLLENLAHGTLASATAKAAS

SEQ ID NO: 8993 - protein, 411 aa, Unknown
  Description of Unknown: Actinobacteria bacterium OV450 sequence
MTSAHPAHIAMFSIAAHGHVNPSIEVIRELVARGHRVSYAIPASFAEKIAETGATPVIWKSTLPTDDEPEAWGTELIDNIEPFLNDAVQALPQLAAAFEGDAPDLVLHDITSYPAPVLARHWGVPAVSLSPNLVAWAGYEEEVAAPMTAALRASERGRAYYARFREWLDENGIDEDPDRFVGRPRRSIVLIPRALQPNADRVDESVYTFVGACQGDRSADQGTWRRPPAADGKKVLLVSLGSTFTRQPAFYRACIEAFGDLPDWHVVLQIGKFTDEAELGAVPANVEVHRWVPQLDILRQADAFITHAGAGGSAEGLATGTPMVAVPQAVDQFGNADVLQALGVARHVPMEEADARTLREAVVALVEDPEVAARSEAVRLRMATEGGARQAADLIEAELPPVSVRRPIVRA

SEQ ID NO: 8994 - protein, 370 aa, Amycolatopsis sp.
MIPAASALARAGHEVLVACVPQLVEEFTSAGLKAVAALPDQAECWSEITDTGHDQVIKVVVGRMLLARGYPELRKVAAWFEPDLVLRDGMEFCGCLVAEQLGIPHVAAPSGAVNTLAPAAIAPLLNERRAEFGLDVQDDPLAIYRYGRIDSLPPRYSFAAHGIPRAVAYRQPEASDRCEPLPSWITELDPGKPLVYGAIGVALPTAAASRDGGKASTIPADPVRALAALVDALSELDCTAVVSTGGVSFPRAGVPPHVRLVEHIAQPLLLQTVQLFVTHGGYNSVREAVRAGVPMVVAPLFGDQLDNARKVAELGLGEQATAPSEIAAACRKVLGSSENLARARHAQRELLALPPVDEVARRLALLASAR

SEQ ID NO: 8995 - protein, 420 aa, Micromonospora sp.
MRVLFTTFAAPSHLQIQVPIAWALRAAGHDVRIAGQPDLADAVARTGHLFVPVGEPLALSEQIDRPDDGSVDFTALADLSCRRPNRRTREYLRTALAISTDVYRALNPEPMIAQLVDLVFDWRPDLVVWDTMTFGGAVAAMAGGAAHARLLFGLDLIARARMEYRRHDAPDDPFRDWLGSALDKYGVAFAEEAVVGQWTIDPVPPSVGLATDQLRVPVRYVPYNGAATATEMTCAPAHRPRVCLTLGQSGRDVLGRDRAASAELLAAAAEIDAEIVATLDARQLAGLGPVPSNVRVVDFMALDVLLPTCSAIINHGGSGSMQTALLHGVPQVVVPDLMWDTEYKAELIERAGAGVWIRDPDFPAPALAAAVRRVLIDPSYREAAARLRREVLGAPTPADIVPALELLTEQHRRPVTAGPN

SEQ ID NO: 8996 - protein, 408 aa, Streptomyces malaysiensis
MRVMFTTLGSPSHGRAQLPLARSLAAAGHEVLVVTTPALTSVFEREEVRVTSGIGDFSPSSFLGPVLAEEAAQAGSPDPADEQSPARMLRLMAKAVSGPMATWLLDTVLPVAHDFRPDLILRDGMDLGSCVIAETLGIPQLSTPSGAANSFDPAAMLPGLNALRKRQGLAIIEDPLSLVPHGRIDYVPPAFSFARHLPASWSYRQTVDVDRGAVLPRWIAELPTDRPLMLAAIGTAIPMLRDSAHEADTPAPPMPMQDPVDTLRAMIQAVSQLEECTVVLATSGIPVDTDGVPPHVHITDRVPQPLLLESVDLFLTHGGFNSIRESLRTATPMAVLPQFGDQPGNAQRVQELGLGRHITDPTPDGIASVCREVLADDGCRARARRARLEMLALPEIDSAVPDLEKIAG

SEQ ID NO: 8997 - protein, 387 aa, Escherichia coli
MRRLPDLDRQAERDFLMRILFVGPPLYGLLYPVLSLAQAFRVNGHEVLIASGGQFAQKAAEAGLVVFDAAPGLDSEAGYRHHEAQRKKSNIGTQMGNFSFFSEEMADHLVEFAGHWRPDLIIYPPLGVIGPLIAAKYDIPVVMQTVGFGHTPWHIKGVTRSLTDAYRRHNVGATPRDMAWIDVTPPSMSILENDGEPIIPMQYVPYNGGAVWEPWWERRPERKRLLVSLGTVKPMVDGLELIAWVMDSASEVDAEIILHISANARSDLRSLPSNVRLVDWIPMGVFLNGADGFIHHGGAGNTLTALHAGIPQIVFGQGADRPVNARVVAERGCGIIPGDVGLSSNMINAFLNNRSLRKASEEVAAEMAAQPCPGEVAKSLITMVQKR

SEQ ID NO: 8998 - protein, 398 aa, Isoptericola variabilis
MRVLFATTAGLGHFRPQVPLARAVRDAGHEVRVAAPASFARHVTDAGLEHAPFDDADPEALGRVFGSLPGLAPEEANHRVVTQVFGRLDPQAALPRLAALVETWRPDVIVREPGEVASLAAAEAAGVLHVVSGIGLGRLHAWMIEGLAEPLQDLAARAGIPDRDLAAAARDEQVFTTLPASFDEPGPALPHDPVRYRAEPDGATAPPLPAWGDPDAPLVYVTFGSVAAGQPTFEPMYPLVLDALADLDARVLLTTGTHGDPDALRPWPANARVERWWPQEALMPAGGEPAATAMVGHGGFGTTTTALATGVPQVVVPLFASDQWLNARRVADVGAGLAVEAGPELVERLPGAVRSVLDDGTYRAPARRLADEMAALPPAAATVERVLTAGSTARTRPS

SEQ ID NO: 8999 - protein, 398 aa, Tsukamurella paurometabola
MLSNVKILVTGIAGYSHLVPFVLPAASALRAAGHDVTVAVPADGRDIVAGYGLDVLALDGIPTMAQIATDPALGEDDFSVRDYVPPAEPYPFTGFTAAAPRRSARAFIGVIGHRGAGALIERLSGDVPDLIVRDNTEFGGYLAAEVLGCPQLPLEVAPMFDASLPGVLDVLNEVRSLHGLPPAAAATEGPRIAQTPLDFYPPEQHVPGIHCFRPGPRTFAPLDPAIADLPADRPLVLVSLGSVAPSLGAATDLVDRIVEALGSLDVYAVVATGGHEVRTPPPNVVLTDFVDQQTVLNTCDAFITHGGFNGVREALQSGVPMVLLPLFGDHPLNSVQADRLGTGIVLDPWTVTAGELAAATEKVLADPSYGRNARRFARRSQALPELATFPERLPEILG

SEQ ID NO: 9000 - protein, 387 aa, Yokenella regensburgei
MIYLVRDVERDFLMRILFVGPPLYGLLYPVLSLAQAFRVNGHEVLIASGGKFAQKAAEAGLVVFDAAPGFDSEADYRRREALRKESNIGTKMGNFSFFSEEMADQLVEFAGHWRPDLIVYPPLGVVGPLIAAKYGIPVVMQTVGFGHTPWHIKGVTKSLSDAYRRHGVSAPPQDLAWIDVTPPSMSILQNDGEPVISMQYVPYNGGAVWESWWERTPGRKRLLVSLGTVKPMVDGLDLISWVMDSASEVDAEIILHLSANARSDLRTLPPNVRLVDWIPMGAFLNGADGFIHHGGAGNTLTALHAGIPQIVFGEGADRPVNARAVVERGCGIIPGDGGLTSGMINNFLNDRSLRDASQEVAAEMAAQPCPTEVAKRLIAALQKGSSQ

SEQ ID NO: 9001 - protein, 433 aa, Unknown
  Description of Unknown: Methylobacterium sp. Leaf361 sequence
MKVLLCSTPATGHLNPLLAIAHMLISDGHEVMVLSGSAFRDRIVAAGARFMALPGAADFDGRDLRAVVPELAEIAPGPDWLRVAMERVFVDRIPDQARGLRAALRAFPASLVIGDDMFFGALPLLLGPRAERPAIVLCGTSILHCARPDRAPVFLGLPPAETPEQEAAYGRIAEAYEAAVDRPVGLSLAAKLAELGRAAPPWPLFDAVVRLADTYLQLTVPSFEYPFPLPPTVRFIGALPIVPGQAALPPWAGDLDGARKVVLVTQGTVANHDFGLLVGPALRALADEPDILTVVTGGGRGLDAIPGPIPANARLSPYLPFEWLLPRVDAMVTNGGYGSVNQALSHGIPLVAAGLTEDKADVNARIAWSGAGIDLAANDPTPETIRKAVRTVLDAPGHRREARRLAAEFAAYDAKAEILRLLSSHGGRARSAA

SEQ ID NO: 9002 - protein, 459 aa, Colletotrichum fructicola
MTVTETCDDVKGSRKPLLLMAAFPIDGHINPLFTIASHLVKVGYEVAFSSPSAYQSKIEETGAEYILAENPITESVFLNFRDASQFPPGPGRLAAQYKAIFMDMQPTRAKTIEEALVVLQARDPHRQIIVLEDVFNSGFTAFKYGRPLPDGVKRLPKSIGFGVSPILAESQDTGPLSLGLWPDSTESGRQRNKALYELVERGPMKLLYDAWHETLKQCGCKNIPDGKIWRSFYTAHDSVLQLCSPSLEYPVSDLPPCLQFVGVLPRKPLKLGFQFPSWWSEVEKRQENNYRYVIFVSQGTLNPLWSELIIPAINAFADRPEVLVVATLGAVGAQLPAEVKIPANARIIDYLPYDAMLEYTDVFISNAGYGTLTHAVSNGVPVLLAGENEEKIEVTMRAVYAGVGLSLGTQTPTAEQVRRGVECILEDTKYKKAAMKLKLENSDLDALSAIEAKIREMTE

SEQ ID NO: 9003 - protein, 404 aa, Streptomyces leeuwenhoekii
MRVLFTTTPAPGHFHPLLPLASAARAAGHEVAFATGRPMSDLAEAMGFRTFEAGLSRDGDQDAEFLELKKSARGLPPTGIEMDRIAIARVLYGVRTRRMVPDLLALARTWRPDVVVRDSYEVGGAVAAECLGVPHAALDTTPLYDMSPLRGDIQRELDQAREEAGLAPDPEQRMLHRHLHLCCAPPSYLPSGRSRPATLRALRPMPFDRADGEELPDWVRWLPDRPLVYVTFGTITNRWVPGAFPGLFSAVLRAFEDEPVNVVATVDRDSDPADLGPQPPHIRVERYIPQSLLLPLCAAAVTHGGFNTVVGAFDAGIPQIVVPFLGDHPYNARRCAELGLARVVDPAELTTEAVREAVREVMTAPEYRAGAQRMRAELRELPGPREAVGLLERLAAGKGLEDHM

SEQ ID NO: 9004 - protein, 380 aa, Actinosynnema mirum
MSRFLFVAPPLVGHVNPLTGVARELVARGHRVAWAGHGELLGALVREPVFPCAVPEDAPVERPAGLTGPSAFQFLWRDFFVPLADAMAPGVAAAVDAFEPDVVVSDQHAVAGALVAERRGVPCVGSASTSAELVDPLASMPKVAAWVDALLAALRERHGNPLARNDPRYPEHGVLAFTTAALAGPVDRPGLHLVGPALGEPRPGVEFPWAELDGRPVVLVSLGTANTGVGGRFLRAAAEAFADRPGVRAVVVDPGGELGPVPDNVLVRHRVPQLELLPRCAAVVCHSGHNTVCEALWHGVPLVLAPIRDDQPLVAAQVVDAGAGLRLRFARAGAEAIGKAVDAVLDPAGGHRDAARAIGDSFRAAGGAGAAADHLIAVAR

SEQ ID NO: 9005 - protein, 390 aa, Kutzneria sp.
MRILVTASPGLGHMLPMVPISWALRAAGHEVLLAMSGRSPDHVPMLAASGLHVVETVRHEQFGSMLDRVRGTEDIKEIQRQIKEASRSGEFDRLSRVGVRLFVPMSEAVADAVVELADEWRPDLVLHSPMEGAGPLAAAKLGIPAVEQSFGLSSPLDRGTQFAEALADTYRRHGADGPPERHVHLDVAPRSVQPEQDGWPMRYVPFNGGGQLPGWLTAARPGRPRIAVTLGTVAPMMTGIGPVARIAALAEKIDAEFVVALGNADTSSLGELPDNVRLAGYVPLGPLLATSAAVIHHGGAGTTLTALDAGVPQIIVPQGADGPFNAAAVAAAGSGLNVTDEELDAQLVERLLTEEPLRDAAGRIRAEMHAMPSPSSVADRLTKNFGGQIS

SEQ ID NO: 9006 - protein, 408 aa, Nocardioides sp.
MKVLCYTSPARGHLFPTVPILLELRGRGHDVVVRTLDAEVARLRDLGLKAEPISPEIEAIELDDYRARTSQAGLKRTVRTFAARARIEVPEVQRLVAEEHPDLLLVDGNTWGAAAVAEASGLPWALLQHFPTPLPARDVPPFGPGLRPLAGPLGRLRNRLLRPVVLGVVERAFLPPLNEVVRPLAGASPIRDAHDLYTRAPLTLYPTSRAFEHPRTDWPDSFCFVGPLVWEPPTAPPEWLAELGRPVALVTTSSEYQDDGALVDAALAGLAHEDLDVVATLPGGSRPRRLVPANAHVEQFVPHSPVLARAAVAVTHGGMGATQKALAAGVPVVVVPWGRDQAEVARRAEATGAAVLLPRRRLSPTSLRDAVRRARRLRPAAVALAAAMAQDGGAPLAVDRLESLAGRG

SEQ ID NO: 9007 - protein, 375 aa, Kutzneria sp.
MRVLVVSAPGVGHVFPIVPLTWALRAAGHDVLVATASAGLVVAGAGLPVVDVLPGYDMRQQFAQLREQHPHFAEMGTRRVRDVKEVGEFLPFLTRPLVPGVLAAAERFRPDVIVEGSMSGAGLIAAARLGVPRVGHGFGFVRPAGMTEMFREHMAAEFEQHGVGLPERMAHVDIAPPSMIAGEPEGWSMRYVPYNGGGVEPDSLGEIPDRPRVAVTLGTVAPTMNGLGPVERIIAAAPDVDAEFVLALGEKVALDSLGPLPSNVRAAGWIPLNSLLASSSLLIHHGGAGTAMTPLTMGVPQLVAPSGADRYINADAVQDRGIGLQVEESELDARVINQLLDEDKFRTTAAEVAAEVAAMPSPAEVAARVIDFVRG

SEQ ID NO: 9008 - protein, 381 aa, Deinococcus actinosclerus
MRVGIVTATYLPSRNGVATSTALFARGLRERGHEVRIFAPRHPLMPPREDGVYRLNSSFAGARALGAPADYPVMLAPGPLLTSRLPLRGLDVLHTMHPFLAGQLALKWARLSGAPVVYTAHTQYDQYLHYAPMPKRVGRAVLRPHVSAFARRVDAVLAPGRAMVDMLREYGFQGHVDLMPNPVDLAAFRAATGAAFREAYHVAPDAPLVVSLGRLAPEKNLDVLLRAFDRARASRPDLRLLVVGDGPSREALERAAPEGVTFTGPVPYERVPQALAAADVFLTASTSEVLPMSMIEALAAGAPLVAAQSPAALDLIQEGVNGTVRAATPEALAEGLLDTLMPAQLPTLQAGARASAAQYDLTTRAAALEAVYEQVIQRKRR

SEQ ID NO: 9009 - protein, 667 aa, Umezawaea tangerina
MTDLLFAVLLAALAACCFAAAIHLQHRTVRDEGRVRVGRLLRTPTWLAGTSLAVVGGGLHVLALATAPLAVVQPIGVLSLVLTTLVGGHSRRAALAVCVGTAGFVVLAATSVAPASSTVDSSRVQLVVAIAAVVAVAGLRTGGRVRCLVLASAAAVLFGLGSALIRGAVLNGSPLLVGEAGALMLTGGWLVHQAYASGPPAVVIAAVTVLDPFTAVAVGIGLYGETGGIALPQLACAAPAIGGVVALTRSTPVDSPSWTRPEPAAGQRILIAADTYPPDVNGAANFANRLAEGLAARGHEVHVVCPSPTSQDSSTVVGGVAVHRIASTRTPFHAAFRVCTPWQVGRALPSLLATVRPDVVHVQAHFGVGRTVLRAALAHDLPVVATNHFMPENLLDHSPLPRVLNGIVSDWTWRDLVRVYRRAHAVTAPTPRAADLLRDRDLPTRAISCGIDLDRFGSAGAHMSTTTTAVFVGRLDPEKNVDELLRALVLAPAVHAEVVGDGVCRTDLESLALDLGIARRVRFHGYLPDDDLVAVLRRGDVFCMPGTAELQSIATMEAMAAGLPVVAANAMALPHLVHHGTNGRLYPPGDPAALAAALRELDADPVSRVAMGTASRRIVARHDLADTLDAFEDLYLRVQEEATGHDHTTTAPARPRRADRERTATAG

SEQ ID NO: 9010 - protein, 389 aa, Deinococcus planocerae
MRIGIVTATYLPSRNGVATSTALYVRGLRERGHDVRVFAPRHPQEPVREEGVYRLNSSFAGARALGAPADYPVMLAPGPLLTARLPLRDLDVLHTMHPFLAGRLALKWARLSGAPVVFTAHTQYDQYLHYAPMPRRVGRAMLRPHISAFARRVDAVLAPGRAMVEMLREYGYGGEVHLFPNPVDLAAFARTRGEAFRAEHHVPRDVPLVMYLGRLAAEKNLSVMLHAFAQAQASRPELRLLVVGDGPARMEAQAGAQEGVTFTGPIPYARGPEALAAADAFLTASTSEVLPMSMIEALAAGTPLVAARSPAALDLVREGVNGTVRDATPDALAAGLLEVLAPGRLPALQAGARKSAGEYDLTERAAALEAVYLQTVAREQAQGRIDRLR

SEQ ID NO: 9011 - protein, 408 aa, Arthrobacter sp.
MSYPADTEPLTILIAADTYPPNVNGAAQFGYRLARGMTGRGHEVHVLAPRASDGPSFTEGRAAWTVHRLRSHGVPTHDYWRLCYPWEIRRDISMLFDRVRPDVVHIQCHYMVGQYTLDEAVRRGIRVVATNHLMPENINPFLPFPEWFKRVIARNSWRDMGKIMGRAAAVTTPTPLAAEAMRTHARLDGVLPVSNGIDSAGYEPRPGEVLEDPEHPTVLFVGRLAEEKHVDVLIDAVARTPEHLGVHLEIVGGGEVKAALQAQAARLGIADRVRFRGLIDDTELRLSYLRASVFCQPGTAELQSLVTLEAMSASTPVLLADAMALPHLVVEGENGFLFRPGDAAELARRITQILELPEERREAMGRASRALVDHHDIRTTLDTFEALYYGSRPVRQGSTGNTGAAQRS

SEQ ID NO: 9012 - protein, 682 aa, Umezawaea tangerina
MTGIAILLAVVGAAFFALAARLQHSAVCDGDGGPRISALLRQPRWLGGLVLLVTGSGVHAVALGMAPLTVVQPVGVLAIGMTALLDGRRRALPAVALTTLAVGAFVLLAAGSATATQVAPEAEVRAGLVVLGLVALPGLLGVLSGRPHLRALSFGVAGGVAYGYVSVLMRAVSQDVQQGAFDWSSAASVLGIATALLVGGWFIQHAYAGGPAHLTVACLTVVDPLVAVGIGAGLLGESARTTGWTALAQIACACIAVGGVCVLARREQTPTGSEKLVNNGRAPRVVIAAETFPPDVNGAARFAHRLAVGLAGRGNDVHVICADPVGPARTELADGITVHRLRSRRTPFYRGFRVCLPWEVRDDVGELLDRLEPDVVHVQAHFVIGRQVLRQAAARGIPTVATNHFMPENLFGHAHVPGWLRSAASRWAWRDLAKVYSVADAVTAPTPRAVQLLHDKGFPHPAEAVSCGIDIDRYRLRPARRDDDDPTVLFVGRLDEEKRVDELLRALALVPRLRAEIVGDGSCRAEWELLAADLGVADRVRFRGFVDEESLLDAYANADVFCMPGIAELQSLATMEAMAAGKPVVAADAMALPHLVRPGRNGWLFQPGDVRGLADRLHGVLADPAVTARMGAASSELIAHHAIGTTLDRFEAIYARVTGAVPVPAAEPVPVVEPVPVVELAA

SEQ ID NO: 9013 - protein, 411 aa, Arthrobacter sp.
MSHPADSKPLTILIAADTYPPNVNGAAQFGYRLAKGMSGRGHDVHVLAPRSSNGRSFTEPGGEWTVHRLRSHSVPTHDYWRICYPWEIRRDISLLFDRVQPDVVHIQCHYMVGEYTLYEAVRRGIRVVATNHFMPENLNPFLPFPEWFKQVVARNSWKDMGKVMGKAAAVTTPTPLAAKAMRDHAFLTEVLPVSNGIDSAVYEVQPGEVVEPHEHPTVLFVGRLAEEKHVDVLIDAVARTPEHLRVHLEIVGGGEVKPALQAQAARLGIADRVTFRGLIDDDELRRSYIRASLFCQPGTAELQSLVTLEAMSASTPVLLADAMALPHLVSDGENGYLFTPGDADELGARITQILELPREDQQRMGAASRAMVARHDITTTLEIFEGLYYGTLSPNDVAAGLTTARAGGADG

SEQ ID NO: 9014 - protein, 385 aa, Deinococcus koreensis
MRIGIVTATYLPSRNGVATSTALFARGLRERGHDVRIFAPRHPLMPGHEDGVYRLNSSFAGARALGAPADYPVMLAPGPLLTGRLPLRDLDVLHTMHPFLAGQLALKWGRLAGAPVVYTAHTQYDQYLHYAPMPPSVGRAILRPHISAFARRVDAVLAPGQAMVDMLRAYGYAGAVQLFPNPVDLAAFRAAGGDAFRAEFHVPADAPLVMYLGRLAPEKNLDVMMHAFNVARASRPELRLLVVGDGPSRAQAQARALEGVTFTGPLPYARVPEALSAADVFLTASTSEVLPMSMIEALAAGTPLVAARSPAALDLIREGVNGLIRDATQSALADGLLAALHRDALAGLQARARESAAQYDLGTLAGNLEGVYQAVMGRGRRRPAG

SEQ ID NO: 9015 - protein, 677 aa, Amycolatopsis balhimycina
MTALAIVCALLAAGMFAAAAARQHREVTGLGVEGAPKLRTLARLLRSPGWWLGTGLATGGSLLHILALSLAPLAVVQPLGVFSLVLTVVFTRRARTPRVLAAVVLVLTGVTGFVTLAAFTTPTTSITFGGAESVAVTGFVLAAIAWFVQAGCAVPAAAAAVLFGLGSSVVHAAVTQPFAAAVLLGGQALLLLGAGGVLLHRAYAAGHTAVVVGTTTVLDPLTAVAVAALVYGETPHLTATVAIPAAAAALVALTGVCVLAGALPQARHRARHRAKENPVSPSGLRVLIGADTFPPDINGASFFAGRLAHGLARRGHDVHVVCPSHDGPPSTEQRDGYTIHRVRSRAIPFHGGYRFCTPGGARQATGPLLDRLRPDVVHVQAHFGVGRALLAAAAARGIPGMATNHFMPDNLLGYTPFPRRVKDTIARWAWRDLVRVYRDARLVTTPTPRAAEVLATIGLERPVEVVSCGIDLAHYAAPARPADRPTSVLFVGRLDAEKNIDQLLRAIAPLPHVRVDLVGDGTRRQELKALAGELGAAGRVTFHGFVSDAELVHRYAEADVFCMPGTAELQSLATMEAMAAGLPVVAADALALPHLVHHGTNGYLFEPGAVSTISRWIAELAADPAARDRMGAESRAIVARHDIDGALAGFEAQYRILLGLPTAAASARGNEEAVTTA

SEQ ID NO: 9016 - protein, 424 aa, Clostridium paraputrificum
MHIAAAGSGWSKSRILMLTDCYAPTVNGVVRSIVDLADGLRDAGHDVRVLTFGEGLGTSFDGHVYRLPSVSAGAVYPHARIGQMIGRRVLRLVAEWAPDVVHSHTEFSAFLWARAIARSTGAALVHTYHTLYADYTHYFCPSERIGRALVRSCTRHVMNRPDRIIAPTGKVASVLRDYGVGCPVDVIGTGVDLGRFRPDVLADAAGPAPNSTSGSASRDLAAAVGLSPGVPTVLTVGRIAAEKNLRESLALLARLDVPWQWLIVGDGPDAGNVRDHVGKLGVGDRVHMTGAVPADEVPRYYGLGDVFLTSSRSETQGLTCLESLASGVPVVCPADEAFAGVVVDGINGHRYTGADDFVAAMTALLSDADLRRSRSIAARRSAGALGRDRFVAEVLAAYGRARADAMTRCRGILRRRDAVRVRVR

SEQ ID NO: 9017 - protein, 380 aa, Deinococcus sp.
MRVGIVTATYLPSRNGVATSTALFARGLRERGHDVRIFAPRHPQVTAPEDGVYRLNSSFAGARALGAPADYPVMLAPGPLLTARLPLRDLDVLHTMHPFLAGGLALKWARLSGAPVVYTAHTQYDQYLHYAPMPERVGRAVLRPHVSAFARRVSAVLAPGQAMVDMLRAYGYGGAVELFPNPVDLAAFRAAEGAAFRAQFHVGPDTPLVVSLGRLAPEKNLDVMLRAFDQARASRPELRLLVVGDGPSRAGLQTRAPEGVTFTGPIPYARVPEALAAADAFVTASTSEVLPMSMIEALASGTPLVAARSPAALDLIAEGENGTVREPTPEALAGGLLDTLAPGQLPALKAGARASAARYDLPVRAQALEAVYERVLTARH

SEQ ID NO: 9018 - protein, 397 aa, Lactobacillus camelliae
MNIGIFTDTYFPQVSGVATSIKTLKDDLERKGHSVYIFTTTDPHVPDDAVEPNVFRFASVPFVSFTDRRVAIRGLFHAYSVAKELQLDLVHTQTEFSMGYIGKFVARQLKVPTVHTYHTMYEDYLHYVMNGHLLRPYHVKQFMRAYLYHVTQVITPSERAKQSLLGYGIKTPMTVIPTGVDLTQFKAAKDPHLRERLGLTDVPVLLSLSRVAYEKRIDKVIAAMPSVLAQVPKAVLLVVGDGPAREDLEHQAQSLGLGQHVRFIGQVDHSDVPDYYRAADIFVSASDSESQGLTYIEALAAERKVVALAASYTNSLLDDPAIGTTFTTQAEMVHQLVNYLQHPHAFDDPAPREAKLRAISADLFGDRVLKVYAHAQERFDEELAEEAERLDEPTMKG

SEQ ID NO: 9019 - protein, 363 aa, Unknown
  Description of Unknown: Halobacteriales archaeon QS_7_69_60 sequence
MQTVAAFTDTYLPTVNGVTYTLRTWRDRWERRGGRMGVVYPGGDGYDPESREYPVSSVGFPFYPGFRFGLPGVPDAARELRPDVVHAHTPFTLGLAARRLAVDRDLPLVVSYHTPAGEYADYISDAFAGVVRHAADRYEQWFFGQADAVVVPSETAADRVDGRTPTHVVSNGVDTERFAPADDAAIAAFRDRHDLPDGPLVGYTGRHGYEKRLGDLLAATAGLDVGVVLAGDGPARAELRRRAAARDDVRFLGFLDREALSTFYSALDAFAFPSPIETQGLVALEAVACGTPVVAVDGGALSESVVDGETGYHFPPGDVDGFRAAIRRVLDETAALSARCRRRRPELDVERSIERLSAVYDGL

SEQ ID NO: 9020 - protein, 392 aa, Lactobacillus equicursoris
MNIGLFTDTYFPQNSGVATSIKTLKEALEAQGHNVFIFTTTDPGVAKDSIEANIFRFSSVPFIGFSERRIAFRGFFEAAKVAKEVNLDIVHTQTEFSMGSIGKFVAKQLEIPAIHTYHTMYEDYLHYVLNGHLLRPVHVKQFTKGYLKNMDGVIAPSPRVANLLTRYGVEIPMRVIPTGVDLGAVSQGEKIDLRKKLGISEDTPVMLTLGRVAAEKKISHILKVMPELLEEFPDLIFVIAGDGPDVDQLKDQVERLTLEGHVIFTGNVEHDQVGSYYQMADLFVSASDTETQGLTYIEALANGRRCVVYKTEYTDQVFDNPVYGTTFETYRQMKEAIEAYLRQGRIEIPEDLLAKKLDEISASRFASRVCDFYQFAIDNYQVKEDKDKDDQN

SEQ ID NO: 9021 - protein, 381 aa, Deinococcus sp.
MRIGIVTATYQPSRNGVATSTALFAQGLRERGHSVSVFAPRHPLMPPHEPGVYRLNSSFAGARAMGAPADYPVMLAPGPLLTSRLPLRDLDVLHTMHPFLAGRLALNWARLSGAPVVFTAHTQYEEYLHYTPMPKRVGRAILRPHVAAFARRVDAVLAPGRAMQDMLRDYGFGGEVQLFPNPVDLAAFQQAEGLTFRAKYHIPPDAPLAMYLGRLAPEKNLAVMLHAFEQARASRPDLRLLVVGDGSSREEAQALASDAVTFTGPVPYAQVPQALAAADAFITASTSEVLPMSMIEALAAGTPLVAARSPAALDLIQEGINGTVREPNADALAAGLLEVLYPAHLPQLQAGARHSAQQYDLRARAEALEQVYLRAIARKRR

SEQ ID NO: 9022 - protein, 384 aa, Lactobacillus sharpeae
MKDQLEARGHSVYIFTTTDPHVPEDAVEPNIFRFGSVAFVSFKDRRIAVRGLFHALQVAKDLKLDIVHTQTEFSIGFIGKFVARNMHIPTVHTYHTMYEDYLHYVLNGHLLRPYHVRQMTRAFVHNDAGVVAPSDRVLEKLASYGVTAPIRVIPTGIELNAYANHSNRDVRAELGLTDVPVLISLSRVAFEKRIDRVIDAMPRILKQVPDAVLLVVGDGPARESLEEQAESLELTDHIRFIGEVDHDEVPLYYRAADIFMSASDSEAQGLTYLEAMAAGTKVLALAGDYTNALLDDPTIGRTFTRTTEMAQLAVEYLTHADEYSDATAREAKLDAISADRFGDRIVKFYEDAQVYYDETLEEKLSSRSFAKTLRLQSVWGKEEE

SEQ ID NO: 9023 - protein, 406 aa, Unknown
  Description of Unknown: Microbacterium indicum sequence
MPAVAAGSVECVPDPTRETPLTVLLGCDTFSPDINGAARFAERLSAGLAQRGHDVHVSAPNTRHALAPTHTETIEGAEITMHRLPSVRLAWHEWLRFVWPWRSKHYARLVLDEVRPDVVHIQSHIVIGRGLAREARRRGIPVVATNHTMAENILDFTRLPEWANRIFVKLAWADAKRTFQMSAAITTPTRKAADYLEKTIDIAGVVPISCGIDMAQYTPDLSPRDGNRVVFVGRLTREKRVDVILRAIAALDPALDVVLELVGDGDQRPALEQLASELGIRGRVVFHGKATDAELRAALTRASAFAIASIAELQSIATMEAMASGLPIVAANAMALPHLVEDGRNGHLFAPDDPVDLAAKLDDVLRQTPSQRERMQRASLELVSAHDITRTLRTFEALYRGEPIPA

SEQ ID NO: 9024 - protein, 415 aa, Unknown
  Description of Unknown: Brevibacterium sp. 239c sequence
MPTETYAPEVNGAAKFAERLAAGLAARGNDVHVACPSATGKASVSTENGVTVHRLTSHRWPLHPTWTICMPWETKPELSRLLDSLQPDVVHTQAHFVIGRYAFSEASKRRIPVVATNHFMPDNVRPYVRAPKPLLDGGTSIAWWDLRRKFQSADFITVPTQLAADLLTQNGFSSPIRAVSCGIDLERFAHLRDDQATASETESAGSPTTPAGSPTAAGPSATAPDTGETPPRVLFVGRLSSEKHAADIVEAVAKTDPALGLEADIVGGGDQEEPLKDLAADLGIADRIHVLGKISDKELMDAYQRCTFFCMPSTAELQSIATLEALASRKPVVLADAVALPHLVRDGVNGFLFPPRDIEELASRFTRICELPDEQLDAMSRASLDVVAKHDIEYTLDTFESIYGKVIAEGLDTAA

SEQ ID NO: 9025 - protein, 381 aa, Deinococcus sp.
MRIGIVTATYLPSRNGVATSTALYVRGLRARGHEVRVFAPRHPQASGPEEGVYRLNSSFAGARVLGAPADYPVMLAPGPRLTARLPLRDLDVLHTMHPFLAGQLALKWARLSGAPVVFTAHTQYDQYLHYAPMPRRVGRAMLRPHVAAFARRVDAVLAPGRAMVEMLRAYGFMGKVELFPNPVDLAAFREARGDAFRAEHRVPRDTPLVMYLGRLAPEKNLEGLLRAFAQARAARPALRLLVVGDGPSREAARVGAPEGVTFTGPLPYARVPEALAAADAFLTASTSEVLPMSMIEALAAGTPLVAARSPAALDLVQEGVNGTVREADPEALADGLLNVLHPARLPALQAGARASAAQYDLPTRAAALEEVYAQTVARGRG

SEQ ID NO: 9026 - protein, 401 aa, Arthrobacter sp.
MNHPAGHKPLTILIAADTYPPNVNGAAQFGYRLARGMTKRGHDVHVLAPATESGASHTEAGGEWSVHRLRSHSTPTHEYWRICLPWEIRRDVSMLFDRIQPDVVHIQCHYMVGEYTLYEAVKRGIRVVATNHFMPENVNPFLPFPSWFKEIVAKNSWRDMGRVMGKADAVTTPTPLAAKAMHDHAFLRKVLPVSNGIDSSAYELKPGEDIEPHPHPTVLFVGRLAEEKHINVLIDAIAKTPVELNVHCEIVGGGEVKPALQAQAARLGLGGRVKFLGLASDEVLRIAYLRATLFCQPGTAELQSLVTLEAMSAYTPVLLADAMALPHLVDGGENGYLFPPNDSDQLAARITELLGLPSADLERMGKASRSMAEKHDINASLATFEALYYGALTEDLLAEYI

SEQ ID NO: 9027 - protein, 663 aa, Amycolatopsis kentuckyensis
MLTLAIGLAAAGACCFAGTVHLQHRAVRGAARGPDLRLSGIRTILRTPGWYAGIGLAGLGAALHVLALTMAPLAVVQPVGVLALVLTVLLARTPLTRTVLAALAMSGAGLAGFVALSATATNAAVDAPDLGTAQWALVAAAGLAAAARSTRGRTRSLLSALGTAVLFGFTSALIRAAAVAPFSLLVIAEAVAATLAGAWLLHQAYASGPAPIVAGATTVVDPLTAVLIGVFAYGELTPGQLAVLAVPGVVAVAGLVLLARELPSPAAPARRTRPEGPLRIAITADTYPPDVNGAANFAARLASGLAARGHDVHVLCPSPGSETFTETTAGVTVHRVGSVRTPFHPTFRICPPWRTARAVPALLAAIAPDVVHTQAHFLVGRSAVRAATAAGVPVVATNHFMPENLLGYGPLPRWTHRPLTRLAWRDLVRVFGRATVCTTPTPRAAQLLEHHGLNRPVLAISCGIDRAHYAGPPDEPAAAPTVLFVGRLDAEKNVQELLEAAVALPPDVRVELVGDGSERGRLEALAARLGLADRVTFRGFVPDADLVRAYRRCTVFCMPGTAELQSLVTMEAMAAGKPVVAADAMALPHLVRPGRNGWLYPPGDVAELAARLTAVLADTPARTAMGQASLDLIAAHDLDSTLDTFEGVYLDVAARPVAVALRR

SEQ ID NO: 9028 - protein, 373 aa, Unknown
  Description of Unknown: Halobacteriales archaeon QS_6_71_20 sequence
MQTVAAFTDTYLPTVNGVTYTLQSWRERWEARGGRMDVVFPGAPDHDPADGEHTTRSVGFPFYDGFRMGLPGVPDAVRDVDVVHAHTPFALGLSGLYLSRQVDAPLVASYHTPTAEYADYLAAGPVAAVVEGAARRYERRYLNAADAVVVPSGPAGDHLRNIGVRSRVEVVPNGVDTAFFSRPDDDEVAAFRARYDLPEPEEGPLVGYTGRHGFEKELDEIPPAVAAADADATLVFGGDGPARETTAAACDAHDVDARFLGFLPREELPAFYSCLDAFVFPSPVETQGLVALEANACGTPVVGVNAGALADTVIEGETGYRYPRGDTAGFAAALDRTLAERATLSRLCLDRRERTSVDHAVRRLAEVYDRVTA

SEQ ID NO: 9029 - protein, 415 aa, Arthrobacter sp.
MSADGAPAGTAPAGASSSSTRAATRPLTILIAADTYPPHVNGAAQFCYRLAKGMKARGHKVHVAACRPDAGKAYTETLPEATVHRLRSRSVPTHEYFRISLPWEIKKDIAAIFDEINPDVVHVQSHYMIGEHVVYEAQRRGIRIVATNHFMPENLNPFLPFPQWFKNIVGKVSWRDMGKVMGRADVVTTPTPLAAKAMHQHAFLRKVLPLSNGIDAGNYELAEGEIIERHANPTVLFAGRLAEEKHIDVLIDAIAKMPADLNVHLEIVGGGEVKNALKAQAERLGLAEKVKFFGLVSDEDLRKAYIQADVFCMPGTAELQSLVSLEAMSASTPVVLANAMALPHLVDNGVNGYLFTPMDSDDLAAKITKILRLSEADRTAMGEASHAMVARHGLNKTLDTFEDIYRGGSYEDHAL

SEQ ID NO: 9030 - protein, 404 aa, Friedmanniella luteola
MSMKILLGADQYPEYINGAATFTRRLATGLAAAGHTVDLLWPAADGAHRTHLDQGVRVHRLSSVTLPGRPRMQVCTPRVVDRQVEQVLQVARPDVVHVQSHLLLGRALVRAGRRAGVPVVATNHFMPENIVPHVPVVRRFPRLASRLAWRDLEQVYAGAQLLTAPTGRAVDLLARATRLAPAEAISCGVDLDRFGAAAAEPDAADATRRGPLALFVGRLEPEKNLDQLLAAFARVPTALGARLEVVGMGSRRGQLEEQARALDLRGRVTFTGAVDDDELVAACGRADVFVMPGTAELQSLATLEAMAAGLPVVAAEAMALPHLVQDGRNGHLVPPGDVDVLARQLTRLLGDPPLRTRMGRASRAVAEGHALAATVALFDERYTQLVEDRRPVPAAAGPDLALVP

SEQ ID NO: 9031 - protein, 387 aa, Deinococcus sp.
MRIGIVTATYLPSRNGVATSTALYARGLRERGHEVRIFAPRHPQQPPHEEGVYRLNSSFAGARALGAPADYPVLLLPGPRLTARLPLRDLDILHTMHPFLAGRLALTWSRLSGAPVVFTAHTQYDQYLHYAPMPRRVGRAMLRPHVAAFARRVDTVLAPGHAMVEMLRRYGFGGEVQLFPNPVDLAAFREARGEAFRAEYGLPQDAPLAMYLGRLAPEKNLDVLLRAFARARVSRPDLRLLIVGDGPSRETAQAGAPAGVTFTGPLPYARVPEALAAADAFLTASTSEVLPMSMIEALAAGTPLVAAQSPAALDLVQAGLNGTVTEATPEALAAGLLDVLDPTRLPVLQAGARASAAQYDLPTRAAALEEVYAQTLTRRQTQSRFSR

SEQ ID NO: 9032 - protein, 397 aa, Lactobacillus nasuensis
MNIGIFTDTYFPQVSGVATSIKTLKDELERQGHAVYIFTTTDPHVADEAVEPNLFRFTSIPFVSFTDRRIAVRGVFHAYAVAKELQLDIIHTQTEFSMGYIGKFVARQLHIPVVHTYHTMYEDYLHYVMNGRLLRPYHVKQYTRAFLFHVSGVIAPSERVEATLQRYGIHIPIAIIPTGVDLSQYKAPKNPELREQLGLTHRPVLLSLSRVAYEKRIDKLISAMPKVLALVPDAVLLIVGDGPARSDLEAQASALELGSHVRFTGEIDHDEVQDYYRAADVFVSASDSESQGLTYIEALAAGRKVVALAGEYTQQLLDDPAIGTTFVTQDEFVHQVANYLQHPQAFDDPVPLQAKLHAISANQFAGSALQFYREAIARFDATADAVDVVNEHTSMKG

SEQ ID NO: 9033 - protein, 659 aa, Amycolatopsis tolypomycina
MLTLAIGLAAAGACCFAGTVHLQHRAVHRAPAGPVLRAVLRVPGWYAGIGLAGLGAALHVLALTMAPLAVVQPIGVLTLVLTVLLARTSLTRAVLAALAMSVAGLAAFVALAATATDAALPSPSLGTAQWALLAAAGLAAAARATRGRARSLLAALATAVLFGFTSALIRAAALDGGPAGFVVAEAVAATLAGAWLLHQAYASGPAPVVAGATTIVDPLSAVLIGVFAYGELTPGQLGGLAVPGVVAVAGLVLLTRALPAPAAPARRKRREGPLRIAIAADTYPPDVNGAANFAHRLATGLAARGHDVHVLCPSPGPASFTETATGVTVHRIGSRRTPFHPTFRICPPWRTARAVPALLAAIDPDVVHTQAHFLVGRHAVRAATAAGVPVVATNHFMPENLLGYGPLPRWTHRPLARLAWRDLAGVFGRATVCTTPTPRAARLLERNGLHRPVLAISCGVDRAHYAGPPAEPAGAPSVLFVGRLDAEKNVHELLEAAVSLPPEVRVELVGDGSERGRLEALAARLGIADRVTFHGFVPDAELVLAYRRCAVFCMPGTAELQSLVTMEAMAAGKPVVAADAMALPHLVRPGHNGWLYPPGDVGELARRLTAVLADEPARTAMGRASLELIAGHDLDSTVDTFEGVYRDVAVRPVPVALGR

SEQ ID NO: 9034 - protein, 364 aa, Rhodococcus erythropolis
MRALRIALIASSRYPVIQPFAGGLEAHVWHLAAALRKVGHDVTLFAGPGSDPELACELIDVRPAPISTAARSDISMPAEHFMQEHHAYLDLMLRLSRDYAESFDVIHNHSLHYLPVAMTSTLNTPVLTTLHTPPTPWLESAIAAGGSPGRFAAVSRYTAEAWRHAAGDVDVVHNGVDTDQWHQGPGGHRLIWFGRIVPEKGAHHAITAARAAGMPLVLAGPVSDHAYFRERIEPELDGTIRYLGHLVTDDLVSAVGMSAVALVTPQWDEPYGLVVAEALACGTPVVAYGRGGIPEILTPDCGRLVPADDVIALTAAIGDAMQLARPSARARAVSHCSERRMVDRYLELYDEIACASTTTRRASL

SEQ ID NO: 9035 - protein, 403 aa, Unknown
  Description of Unknown: Curtobacterium sp. B18 sequence
MSDDATTATAEPTGATGGRRPLRVLIAADTFAPDVNGAATFAEQLAVGLAERGHEVQIVAPASSRHYGTFDEELHGVTLVVHRLKSYKWPLHAWLRFVWPWSVRKWTAPILDAFQPDVLHIQSHVVVGRGMVPEAHARGIRVIATNHFMPENLLEYTPFGKRTVPIAVKIAWNDAAKTYRLADAITTPTNLAADYLRRAIAGQRVLAISCGIDATRYVAREGRPANNDIVFVGRVAPEKNLDVLVKALALLPAELDTTLTIVGDGEMIPKLTHQAKELGLEDRVRFLGFVSDEAKRQALTNSTVFAMPSTAELQSIASLEGMASGLPVVAADSMALPHLIDGNGFLFTPGDEHDLAAKLTAVLTASDDDYVAMRHRSLAMIEAHDINRTLSTFESLYRGEPVD

SEQ ID NO: 9036 - protein, 405 aa, Gryllotalpicola ginsengisoli
MGCDTFAPDVNGAARFAERLAAGLVARGHEVHVIAPAYDGVGERDEVHEGATMRVHRLFSLRWLPHDWLRFMMPWTMERNSGRILDRVKPDVVHFQSHFVVGRGLSVAAVRRGIRVVATNHTMPENMLEYTLVPKFLQPILLKWSWWDAGRIMRRACAVTTPTQRAAEYLTAGTGIPNVLAVGNGVRVAEYTPNFAPRTENRILFVGRVTGEKRIDVLLRAIPLLPESLDVKVEIVGDGDQKHHLERMAQQLSIADRVTFSGHVDEAELKRAYTRATVLAMPSTAELQSIVTMEAMSSGLPVVAADAMALPHLVHDGENGYLFRPDDEHDLAAKLEKLLTLPPAEFTAMKMASLRLIQIHDIDRTLDTFECLYRGLPVADALAEPDLGEVAEEGEVAGEDATAGR

SEQ ID NO: 9037 - protein, 378 aa, Deinococcus irradiatisoli
MRIGFVTTTYLPSRNGVATSTALFAQGLRELGHEVNIYAPNHPARPPAEPGVYRLPSTMMGAPADYPILLWPNPAVVAGLPLRGTDIFHTMHPFLPGMLARLWGRRFQAPVVFTAHTQYEQYLHYAPLMPRRMSRGLTRAHVATFARSVDQVLVPGRAMQEMLRGYGFMGRVAQMPNPVNLASFQAADTPQVRAAVRARYGVDHSAPLVISLGRLAAEKNLDLMLRAFGQARASRPELRLLVVGDGPARSALEARNTPGAVFTGAVPYAEVPHMLAAADVFLTASTSEVLPMSMIEALAAGTPLVAARSPAAEDLIRGGNGLIREAREDALAAGLLEVLAPAALPERRAAARTSAEQYDLRVRASALARVYEGLLVRR

SEQ ID NO: 9038 - protein, 377 aa, Rhodococcus sp.
MSALRIALIASSRYPVNQPFAGGLEAHVWHLAAALRKAGHDVTLFAGHGSDPQLACELIDARPAPISTAARTDISMPAEYFMQEHHAYLDLMLRLARDYAESFDIIHNHSLHYLPVAMASTLSAPVLTTLHTPPTPWLESAIAAGGSPGRFAAVSRFTADSWKQAAGDVDVVHNGVDTDQWSQGPGGHRLIWFGRIVPEKGAHHAIAAARESGMPLVLAGPISDHTYFRERIEPQLGDSVRYLGHLVTDDLVAAVGMSAVALVTPHWDEPYGLVVAEALACGTPVVAYRRGGIPEILTPDCGRLVPADDVAALSVAIGEAKQLARPHARARAVNHCSERRMVDRYVALYNEMYSAPTISGASTAETVPTATTRRVGR

SEQ ID NO: 9039 - protein, 382 aa, Deinococcus sp.
MRVGIVTATYLPSRNGVATSTALFARGLRDLGHEVRIFAPRHPQMPPREDGVYRLNSSFAGARALGAPADYPVMLAPGPLLTSRLPLRDLDVLHTMHPFLAGQLALRWSRLSGAPVVYTAHTQYDQYLHYAPMPKRVGRAVLRPHVSAFARRVDAVLAPGRAMVDMLREYGFAGRVDLMPNPVDLASFRAAGGAAFRTEFGVGPETPLVMYLGRLAPEKNLDVMLRAFTRARASRPELQLLVVGDGPSRAPLQAQAPEGVTFTGPVAYARVPEALAAADAFITASTSEVLPMSMIEALAAGAPLVAAQSPAALDLIEEGVNGTVRPPTPEALADGLLDTLHPDRLPALQEGARLSAARYDLPMRAAALAAVYERARQERPRR

SEQ ID NO: 9040 - protein, 667 aa, Amycolatopsis sp.
MLTLAIGLAAAGACCFAGTVHLQHRAVRGAATGPTLRLSGIRAILRTPGWYAGIGLAGLGAALHVLALTMAPLAVVQPIGVLTLVLTVLLARTPPTRTVLAALAMSVAGLAGFVALAATATNAALPAPALGTAQWALLAAAGLAAAARYARGRARSLLSALGTAVLFGFTSALIRAAAVAPLAGGPAVAVVAEAVVATLAGAWLLHQAYASGPAPIVAGATTVADPLSAVLIGVFAYGELAPGQLAGLAVPGFVAVAGLVLLARELPAPAAPARRTHRDGPLRIAITADTFPPDVNGAANFAYRLASGLAARGHDVHVLCPSPSVETFTETTAGVTVHRLGSVRTPFHPTFRICPPWRTARAVPALLAGIDPDVVHTQAHFLVGRSAVRAATAAGVPVVATNHFMPENLLGYGPLPRWTHRPLARLAWRDLVRVFDRATVCTTPTPRAAGLLERNGLNRPVLAISCGVDRAHYAGPAAEPAGRPAVLFVGRLDAEKNVHELLEAAVALPPDVRVELVGDGSERPRLEALAARLGIAERVTFHGFVPDEELVRAYRRCAVFCMPGTAELQSLVTMEAMAAGKPVVAADAMALPHLVRPGRNGWLHRPGDVADLAARLTAVLADEPARRAMGQASLELIAAHDLESTVDTFEGVYLDVARRPAPVALRR

SEQ ID NO: 9041 - protein, 367 aa, Halorussus rarus
MEQVAAFTDTYLPTVNGVTYTIASWRKRWERAGGRMDVVYPKADGHRPTDGEHPVGSLPFPFYDGFRLGTPKIPRAVRDAEVVHAHTPFGLGLGGLRLARDQDVPLVASYHTPTSEYASYVSPTDTVASVVGRISESYERWFFGRADAVLAPSAATRDHLIEEVGVDTTVEVVPNGVDTERFRPVDPDEFLARHDLDGDRPLVGYTGRHGYEKRLSELVEAAAEMDVTVVFGGDGPARDDLEAQAADLGADARFLGFLDREEMAAFYSALDAFAFPSPVETQGLVALEANACGTPVVGANAGALANTIDDGETGYHYESGDVADFRAAVRRTLTEREALRETCLARRDEVGVERAVDRLRDVYDRIR

SEQ ID NO: 9042 - protein, 346 aa, Unknown
  Description of Unknown: Methylobacterium sp. V23 sequence
MIRVAQVAPNIFPVPPRHHGGTERVIHDLSTALVDLGVEVTLFAPSDSATGLPRIGDQPSLAALEQRHGRVAPGVPAALDALQLEALRSRLDQFDIVHCHGEFAHAALLGARRRHSLTTVHWRVDELDRELFFAGFPDLPVAAISAAQAAGIPPANRAGIVHHGLARDRYALSTQPGPHVAFVGRMTDQKRPDTAIRVARAAGLPIRLGGTIDVGNPDYFEHRVRPLLGEDAAYLGPVDDARKADLLGSARALLFPIDWPEPFGLVMIEAMACGTPVVAWNRGSVPEIVEDGVTGFIVASEADAVAALARIGELDRTRIRRRFEARFTAERMAADYLALYRRLLAA

SEQ ID NO: 9043 - protein, 384 aa, Deinococcus marmoris
MKIGIITATYLPSRNGVATSTALFVRGLRERGHEVRVFAPRHPLMPAREDGVYRLNSSFLGARALGAPADYPVLLAPGPLLTSRLPLRDLDVLHTMHPFLAGGLALKWSRLSGAPVVFTAHTQYDEYLHYTPMPPRLGRAMLRPHVSAFARRVDAVLAPGRAMVQMLHGYGYSGHVELFPNPVDLAAFQAADGSAFRAEHHIPLDAPLVMYLGRLAPEKNLEVMIRAFDQARASRPELRLLVVGDGPSRLSAARDAPEGVRFTGPVPYARVPEALAAADAFLTASTSEVLPMSMIEALAAGAPLVAAHSPAALDLIGEGINGTVREATPQALADGLLFALHPNRLGALQAGARASAARYDLPQRAQALEEVYERVRAGHRRQKA

SEQ ID NO: 9044 - protein, 409 aa, Arthrobacter sp.
MSYPADFKPLTILIAADTYPPNVNGAAQFGYRLAKGMAGRGHAVHVLAPRPSNGPSVTEPDGDWSVHRLRSHSVPTHDYWRICLPWEIKRDISLLFDRVRPDVVHIQCHYMVGQYALYEAVKRGIRVVATNHFMPENINPFLPFPEWFKRIVAKNSWRDMGKVMGRAAAVTTPTPLAAKAMHDHAFLREVLPVSNGIDAAAYEVRPGEVIEPNEHPTVLFVGRLAEEKHIDVLIDAVARTPEHLEVHLEIVGGGEVKPALQAQAARLGISDRVRFRGLIDDEELRRSYIRASLFCQPGTAELQSLVTLEAMSASTPVLLANAMALPHLVSDGENGYLFEPGDADQLGKRITEILSLSREEQQAMGAVSRAMVGKHDINATLETFEGLYYGTLSSQPPAPREADLAGRIQ

SEQ ID NO: 9045 - protein, 673 aa, Amycolatopsis vastitatis
MLTLAIGLAAAGACCFAATVHLQHRAVRGATTGPELGLSGIRTILRTPGWYAGIGLAGLGAALHVLALTMAPLAVVQPIGVLTLVLTVLLARTALTRAVLAALAMSVTGVAGFVALSAMTTNPALPAPGLGTAQWAVLAAAGLAVAARFARGRARCLLLALATAVLFGFTSALVRAAAVAPLTGATAAMVIAEAVAATLAGAWLLHQAYACGPAPVVAGATTTADPLSAVLIGVFAYGEMTPGQLAGIAVPGVVAVAGLVLLARELPAPAEPASVGRPRREGPLRIAITADTYPPDVNGAANFASRLASGLAARGNEVHVVCPSPTGETFTETTGGVTVHRIGSVRTPFHPTFRICPPWRTAKAVPALLDGIDPDVVHTQAHFLIGRSAVRAATAARNIPVVATNHFMPENLLGYGPLPRWTHRPLARLAWHDLVRVFGRATVCTTPTPRAAGLLERNGLNRPVMAISCGIDRAHYAGPPTGAADAPAVLFVGRLDAEKNVHELLEAAVMLPPHVRVELVGDGSERARLEALATRLGIAERVTFHGFVPDEDLVRAYRRCAVFCMPGTAELQSLVTMEAMAAGKPVVAADAMALPHLVHPGRNGWLYPPGDAPELARLLTAVLTDERARTAMGEASLDLIGAHDLQSTLDQFEGVYADIAVHPVIPALSSGVA

SEQ ID NO: 9046 - protein, 644 aa, Amycolatopsis sacchari
MIVLAILLAVVAASCFAASVSLQHGAVRETGHGLSPRLMRSRRWLAGTALGATGAGLHVVALALAPLAVVQPIGVLSLVLTVVFSSRARLSAVLAVCVGTAGFVLVAATSTAASADVDPVGVQVPVLGALVLAGLAVAIRGRLRCLLLATAAAVLFGLGSALIRAATQDFALWPAAESAVLILLGGWLVHRAYDSGSPAVVVGATTVVDPITGVAVGLWLYGESAVLAPGQAVALAAFAALSVTGVLVLAKETPPQKGTRMPHGDGLKILIGADTFPPDINGAANFAGRLAQGLAGRGHDVHVVSPATAVPIGARGITRHPVSSVRTPFHPTFRVSPPWRATREAEAVLRRVRPDVVHVQSHFPVGRAVLRAARRQGIPVVATNHFMPENLLGYVPVPRALRGPVVRWAWRDLVRVFGAAQVVTAPTPRAVDLLTTHGMPGSPLAISCGIDLAHYPPHETAGKTVLFVGRLDAEKNVDELIRAVAVLPDVRAEIVGDGGCRLALTALARELGVADRVRFRGFVSDAELAHAYREADLFCMPGTAELQSLATMEAMAAGLPVVAADAVALPHLVRDGVTGFRYPPGDVPRLAAAIGEVLGSPATATAMGRAGRELVSRHEIGHTLDAFEAAYRSCWAEEPLPAAG

SEQ ID NO: 9047 - protein, 1103 aa, Copidosoma floridanum
MRTRKLLLLLLVPTLLFADHCSCYRILGIYPFVGKSHYIMMNQLFKGMARKGHQVDVITPFPQTENVPNYTQIFQFPDKTAEIIGHLNYDIIKGFSRTGNLSSVLDIGYKLCEYMGMPEFLNLARHPPKDPPYDVVITQVFNSNCFMVLGHLWNVPVVLVSTSALYPHVHDMIGNPENVAISPNNFSPVPPGAGGLWWRLYNAYFFYTVKSAFVFHSRNQNELLHRYFGPRVPDIRQLERSASLLLVNTYFPVNGVKPTTTGLVEVGGLHIQNDGPEMTDDLKRWLDESKDGVVYFSLGSILRIEIFPEETVAVIFDSLGRLSPTRVLMRVANPESLSVKLPPNFRTLPWMPQEKILQHPSVRVFVTHGGLLGTQESVFYGVPMLCLPVLADQWTNTQNYVQKKVAVSADIMSLTQETRETFDGAVNEVLGNPVYRDNVRELSRLFRDRSLSPMDTAAFWIEFVVRNGKDVLRSPAMDLTWWQLDLLDVLAVTTAGLSLILFVAVFTIKTLLRCLLGKSRTSCVSKRKKDTDVAVVPREFRVIVGLTVVDDSSWLTLPIDLDCTPCSKSVPCIVKINMNFSTVVVLLVCLLCTCDAYRILAAFPFHGRSHTIVLQETAKALVRKGHQVDVISHYPLEKPTRNYNDIVKLRSSEEYASIDYKTMMSMDEEDKWIYDILKGICDHLGNPEVQKLVKEQQKHRTYDLLLVHYLSGYQCFPAIGHLLDIPVVGVVTTSLYPWMHGFVGDPLNLWLHPSNLRPWKNEDLTFWGKLYNVLVTHRDISEHYKNAGFQQRYIDRYLGKGLPDYRQLERRTAMILTNSHYTYHGIKPKAPAVVEIGGIHINNDTTVSMDSSLKSFLDDSKDGFVYFSFGSMAVVETMPKDLLDRFYGVFGKIAPVRVVMRAPNPRALPKPLPGNTLVRSWLPQQQIFLENFFSEHPNIRAFVTHGGSLGTQEALHYAVPMICVPLFAEQHLNCDILANKRVARKLELRSARLSDYESVFQDVLSNYQTYKTTTARCSRLYRDRPRSPADELVYWVEYVIRHGRNALRSPAVDLTWWQVDLLDVYAFLATSLLLVSSLALFALRKLFVVFLRPKGTANKEKRH

SEQ ID NO: 9048 - protein, 235 aa, Ancylostoma duodenale
LSTDLVSENVHLFKWLPQTDLLNHPKTKAFITHAGYNSVQEAIHAGIPMVCLALFGDQPKNAKVTEKLGISRNLKKSELTAETIAAAIREVLENERYDKNAKKLARMVRNKPVSPKDLLIRWTEFLAEFKTLENLTPAGNKLNWIQYHSIDVLSTDSLGKSIRLTLFNPKKNTMKQCSRRSLSTSNQATLIDLALLTVEKDNCEHVARNVFKIFFDIVLIKISAWVEYLQGRIHY

SEQ ID NO: 9049 - protein, 354 aa, Helobdella robusta
NTLILDWLPQNDVLGHPSTKLFITHCGNNGIHEALYHGVPMLGFPLFAEQGENCRRMIAFEFGIKMDIFTFTEAELVENVLEILTNPKYKSSIKQMSKVFKDQPMAPLQKALFWMEHVIKHGGSHLRSSAIDLPLYQFLCFDTIAVLLLIITIVTFAVFQVSKFSLLYFYEVDHHFNSFIPNFPNHISVAGLTCSPAQNLPKNILDFINGRIVDGKDPGVILMSFGSFVDYMPNRLIEKFFKVFESLNETILVRYKIKQNDTQPKPTIPTNVMISDWLPQNDLLGHPSTKLFITHCGNNGQHEALYHGVPMLGFPLFAEQDENARKVIALQFGLIMDIMTFTEKELFGWFISVF

SEQ ID NO: 9050 - protein, 356 aa, Lottia gigantea
MVILDNTPIAQTLCVIPYKYNISFIYLGVNFEPFSAAIPFSTAFVPYKGLPLSDQMTFTERLGNAVSMYAPERPSIAVREIQKQAALHLIEWNFVLDYPVPTLPHVILIGQITPKHSRKESLSTELEDFLERSKHGVVLVSFGSIAPTTRNDVLDKMVSAFQETKYNYIIKGSFTNSTNKNLVVDWMPQKLLLTHPKIKLFITHCGANGLGEAISNGVPLLGFPLFAEQPGNAYRVQSRGFGLTMNLFEATKEEIVKGIDEVIDNPEYKMKVQRASEILKARDLNGLDQAIFWIEHVLKFGGEYLRSSGIDLPWYQYFLLDVIAFLLTCVSFMVSIIYFCLKCIFRRCVSRKLKGD

SEQ ID NO: 9051 - protein, 488 aa, Oryctolagus cuniculus
MACLLSAAQRASAGVLFVALWGTVLGDRLLVVPQDGSHWLSMQDIVEALGARGHEIVVLVPEVNLLLRESRFYTRRIYPVPFDQEEQSYRYRTFGEKHFTDRSWLSEPQTEYRKLMVVIDMYFINCQSLLRHGDTLDFLRAGKFDALFTDPFLPCGVILAEYLGLPSVYLFRGFPCSLEHGFGGSPNPVSYIPRCYTKFSDQMSFPQRVVNFLVSLLEVPLFYCLYSKYEDLAVELLKREVDLPTLFQKDPVWLLRYDFVFEYPRPVMPNMVLIGGINCKKPDVVSQVLWRYTGSRPSNLAKNTILVKWLPQNDLLGHPKTRAFITHSGSHGIYEGICNGVPMVMLPLFGDQMDNAKRIETRGAGVTLNVLEMTSDDLANALKTVINDKSYKENIMRLSSLHKDRPVEPLDLAVFWVEFVMRHKGAPHLRPAAHDLTWYQYHSLDVIGFLLAIVLTVAFVTFKCCAFAWGKCFGKKGRVKKAHKSKVH

SEQ ID NO: 9052 - protein, 521 aa, Fopius arisanus
MSGITSIFLSAFLLIINNENASALRVLAIYPFPGKSHSIGAEHLLEEMTHRGHTVDVVSHFPREKPIPNYRDISLRGLAPVFANSVTYDKIRQYNFIHPREFVELAGTGVCDLLGQPVLQELMKTPKGTYDVVIVHLFLAHCFIGFGEKLNAPVVGVVTSKLPDWMFDAFANPLNPSYMPSFFSSSTQRMTFWERLRNTVVTNRFRLQLCYYMEAESQQVERYFSRKISSLDELYKDVALVLVNEHFSVNDIKPATPDIIDVGGLHIYNNTQQLTTELRDWLDESTEGCVYFTFGSTVNFESFPEEVLRIFYRSFERIAPVRVLMRGDPEFHSKDLSKNVKIVPWAPQIAVLKHKNVKAFITHGGLLGTQEAIAYKVPLIGIPLFADQYTNLRNYANRGFAVVLELKALTEDSLTDAIITVLRDPTYSENIARVSELFWDRPMNPLDTAIYWIEYAAKRGPVLKSPASELSWWKFHLLDVYGFMLMCALTILCAIIKLITLLRSRASRVLPKKVPKSKKHN

SEQ ID NO: 9053 - protein, 309 aa, Unknown
  Description of Unknown: Oryza sativa Japonica Group sequence
MVMGYKCFTLKSSPELSMAGVDATAAGGDEAGETLHVVLFPFLAFGHINPFAQLARSLLAVGGVRVTFLSAAANVAHVETRDHAACGRPSPSWHCICRAFRGSPRAQRARRRSTRTAPSCSSSPSTARGRRWRRCSRGSARTSCSSTSSRRGSPTLPGVSASGRRGSRSSPRSPARTSWPTGAASTARARPPRSSRRRPRGSRRRRRSPRCRPTRPPTSPTFSPASTACRARMTAPSPATTPATRSSSGPATRWKAPTSTTSRRSMASRCSPRGHWCRSHREASWRRGSRRGSPPSRTRPSSSPWTNIE

SEQ ID NO: 9054 - protein, 520 aa, Halyomorpha halys
MNYILAIILVATSIVALEGAKILIALPIPWYSHTMTFMPAFKELAKRGHQVTMVSPFPQKKPLANWTDLPVDPKPMLAVMDHHLADRVTSGHNVHTFYISAWDFFTNIMEAAFQDPTLQEVIKSENLDYDLVITEPFYGLEPLVALGHKLNVPVVAIHPLSLTPWGSYLTGNEMSFHLMPNIRTVYTNEMTFFQRLNNVLVNLIEFSVAYFHYLPTKVKQMEKYMVYPGSVNRPSMLDMLQNVSLTLIDYHPSILYAEPLQPNSIPVGGLSLSHVDELPKDLKDVLDNAKNGAVFLSFGSLFRGKALESRVLSVLFETFSQLDQVLLMRWHTEDVPNKPKNVIIKTWMPQPSILAHPNLKLFITHAGLHGITEGAYFGVPLVCMPLFSDQEYDSRFVEKAGFGTVLLLKDFNKETLLANINEVLKNPKYKEVAMERSKIIKDKPQTALELAVYWVEYVIRHKGASHLKPGRQQLSLYQTLGLDIITFVLFLIAILILVTCKTISFLKLQICKNSVKTKKE

SEQ ID NO: 9055 - protein, 311 aa, Trichomalopsis sarcophagae
MDVKILLLLAIVGNTEICKGCRILALYPLPKQSHFMMINQLLKGLALKGHQVDLITVNTLPKSHSNYMQIMKLPDNANPIFSRYENIKNLHYNFSMMSWMGYLRCQKMEHPEFLNLARNPPKAPPYDVIIVQDAKPITSEAFWSRGTDYTRFTDSYTKKNVPDNVLIMSWIPQEKVLQHPNVKVFIMHAGLLGTQESIYYRVPMLCVPLAFDQWSNANNYVSKKIAVKVDLASVTQTKIDEALNEMLTNPIYRENIRKYSQLFRDRPQTAIDTANYWIEYVKRNGKNSLRSATMDFTWWQIYLLDVPDRNH

SEQ ID NO: 9056 - protein, 524 aa, Amyelois transitella
MFYKQHSLFLLSFAIFCEAANILYVIPFSSKSHYIFLKPIGLELARRGHNVTVITSYKEAKPPKTYHEVMVDNKSIWEIIGGERPNVFTMVGLSAEEFHDKILWSGGLAMTEVALNSKEVQELLKNDHKFDLVISEQFFQEAMYVLAHKYDAPLALVTTYGNCMRHNIITRNPLQLSTVISEFLDIREPTSFWGRLRNMYFALYEFVWWKYWYLEKQEALVKKYVPHLKEPVPSLYDLQKDTALMLYNSHFSFDNAAAYGPNIVEIGGVHLSKSDEVLPKDLQEILDGAKHGVVYVNFGSNVKSSELPLEKKNTFLNIFRELKQLVIWKWEDETLDDKPKNLIIRKWLPQKEILSHPNIKVFISHGGLIGTQEAIFHGIPIIGIPIYADQFNNLLQAQEIGFGQILEFKDINEENLRNKLNNVLKDDKYGVKAKEISARFKDRPMSALDTAVYWLEYVIRNKGATYMKNPALKLNRIASTMLDVYAFIFIVFTTIFFILTKTLNIISAALSTNVSKNKRKQKRN

SEQ ID NO: 9057 - protein, 524 aa, Sipha flava
MYYQILTVMLLALGNHVQPTDGANILAFFPLPIYSHFSGFNPLFLELADRGHRVTVVSPFQPKGTVPSTYKHVSITNVRIPRRTNLLDIPKSYRITNMINVRKTMMEMVRRTLVLKDTQAFLNDTRNAFDLVLSECWYSDAFLAVGHRYSAPVMCLSPMMPSATLCAALGSPNNPSFVPSFWLHYSDAMRFSERLFNAVITAAEMLLSGVVYRDVDQEMADALFTYPGHEHRPPMDELRGAVAVTLINSHHSVSYPRPYPPGFVSVAGMHMRPKKESAVKVEPEFKMLLDSAIDGIIYFSFGSNIKMSDLPEHYVRMFVESFRKLPQKVLWKWENGSIDNAPDNVYVASWFPQQYILSHENCKLFITHGGYHSLVEALHAGVPLIGFPFFTDQYYNMRFVVENGFGIEIMLNDLRENVLDDAIGSIMFDSSYKEHARRASEIFLDLPSSALDTAVYWVEYVIRNGPDFKLSLQSHRLNWYQYFLLDVIVSIIVILVSTAFFFYALIKFICKRYFNSSFKIEKLN

SEQ ID NO: 9058 - protein, 238 aa, Helianthus annuus
MEGICLKDFPIAWTTDPMDEVLKFSIQLNQRSHRVSHHIFHIFEVLEGSVIKALSSMYDHVYTIGPSQLLLDQIPETGSYSFPGYSLLKEEAECFEWLESKEPNSVIYVNFGSTTVMSLKDLLYCELVFAGKGSELSVGWRVFESLWVGSTIESLSAGVPMICWPHRLDQVTNCRYICEEWGVGVKMQGSKVRRDEVTRLVQELMGEGGSRNKEQGCRVEGKGARCRRSLRFVFVERG

SEQ ID NO: 9059 - protein, 448 aa, Choristoneura fumiferana
MFVQLILVVLAPCFVCSSNILCVFPTPALSHQSVFAAYVDKLVIAGHNVTVITPMPRGVQHVTEIDCSTKNVFVNLVKNSTSLKKRGLVADELTVTAENYTPIIDMVVEQIKSYNVTNLLKNKDNNFDLVVCEAYLDIILIFGHLYRTPIIKFSSGYGTNENFKTMNADVKYNSVVYPNLWRSNFSNENIEQALNTEWQKLKQIQNIRLQKLFGDRTSTISVMQQSVKLLFVNVPHVFDSDRPVGENVQYLGGIHLKKPRPVRDIKLIEFLNQKTNIIYVSFGSILDAAAMDESLLTEFVKVFTKFNVLWKIDNVVSSKFNLSDNILTRNWFPQRDILNHPNVKLFITQGGVQSVDEAVDSEIPLICIPMVGDQFVNCRRIDQLNIGVVVNILKLESENLYKKINDVMNDTTIVDKIHALKKNIHDAPMKPLHKALWYTQKVLRNNKY

SEQ ID NO: 9060 - protein, 293 aa, Helianthus annuus
MDAKPIVGRKKPHVVFIPYPAQSHIKCMLKLARLLHHRGLEITFINTEWNHKRLFKYGGSSGLDGILGFRFKTVPDGLPSSSADGTEPTQTVEELGLYLLTNFLDPFLDLVAGLETPPTCIICDGTMTFTNIIDATEKLKIPIFLYWTMAASGFMAFYMAKILLEKGILPLKDESYLTNGYTDTLLEVPGMQKVRLRDLPEHLLATKLDDPSFNWYVDSARRADKVPHVIIHTFDELEAPLIKEIKSRFPHTYTVGPLQLLVNQITENETKKTNFNGYSLWKEEPECYNSNVF

SEQ ID NO: 9061 - protein, 379 aa, Unknown
  Description of Unknown: Oryza sativa Japonica Group sequence
MAKGHVLVLPMPCQGHVIPFMELSHRLADEGFEVTFVNTEVDHALVVAALPPGGAAELRQRRIHLAAIPDGLAGDEDRKDLNKLIDAYSRQANRGWRPQREGVAGAAGDAAAGAGDAAAAHVAAVVEQLRRGGRAAHHLRPRLPEQQVQRRPRRDDRLQLLPRGRARRLQALPGPPPHRPARRRPRAPPSRRPLLAGGRRLPGLARRAARRLRRVRGLRQPGHLRREAVPGARRGAGAHRPAVPLGCPAGLHPWPEHGVAGRLPAPRRRQGRDRRVVLAAARAGARRRGVLRVALWVELDAGRGAQRRAVPVLAVLLRPVPRPELHHRRVAHRARRGGRRGGRRRDEGRGEEQGGAGRRRRRDQGEGAAAQGHGARLRQ

SEQ ID NO: 9062 - protein, 407 aa, Fukomys damarensis
MEGSHWLNVKIIIDELIKKEHNVTVLVASGALFITPSSHPSLTFEVYKVSFEKEKIEKVIILTWLENRPSPLTIWRFYQEMTKVIKDFHMVSREICDGALKNEKLMENLKKGKFEVLLSDPVFPCVTMCANFLHPNFIFSGKPTTLCETMSKAEIWLMRTYWDFEFPRPFLPNFEFVGGLHCKPAKPLPKEMEEFVQSSGEDGVVVFSLGSMVQNLTEEKANLIALGLAQIPQKVSATSGPGHPKTKAFITHGGTNGIYEAIYHGIPMVGVPMFADQPDNIAHMKAKGAAVEVNMNTMTSADLINALRTVITDPSYKENAMRLKRIHHDQPVKPLDRAVFWIEFVMRHKGAKHLRVAAHDLSWFQYHSLDVIGFLLACVASVVFLVTKCFLFTYQKFIKSGKRIKKE

SEQ ID NO: 9063 - protein, 856 aa, Biomphalaria glabrata
MDVCDLGRDFAVGEFIASNIVTAVKESRKTLVVLTRNLLNSTWCNFEMQMANMESVHTGRPVLVFLIKESIPTAELTSDLLYHLNKNTISCKYVYVFNVVYVFNEVYVVSVVYVVNVVYVVNVVYVVNMVYVVNVVYVVNMVYVVSVVYVVNVVYVVSVVYVVNVVYVVNVVYVVNVVYVVSVVYVVNVVYVVNVVYVVNVVYVANVVYVANVVYVASVVYVASVVYVVNVVYVVNVVYVVNLVYVVNLVYVVNVIYVVNVVYVVNVVYVVNVVYVVNVVYVVNVVYVVNVNSKMLSLTQLLIMASIVSLEFCGAKKVVMIPPLSKSYLIYHANIGQALIELGHNVSICVPDYLANKGLVPHKKINIIKYGEYLGDVEALVYEKTQLIEKFWAGGVETVGSLIPIVNFCKELLEQILSDETFITSLRDLKPDFFIIENFMFTRNILVLPYKLDVPFGLIGTYHDYFLSRTPFSPAADQLFFDDGGDRKSFLQRVQATILSAAFTVYDIFSDSDVVSRYAPEKPSISIRDIALKAEIFITEIDHILDYPRTSLPNTKLVGGSSVSEAKPLSGDMKHFVDKSSNGIVVVSFGSGNVYIPDQIRSKMANAFLKLNLNVIWKINGTFEQQDKILASNWIPQNDLLGHPKTKVFVSHCGKNGQYEALYHGVPILCLPMYGDQFYNSKRIAVKEFGHYADIREITSEKFSALIQEIADDPKYRNNIKKASKLFKELYKVPSKEAAYWFDHVMKYGGSYMRSTGQQMPLYQYLLLDVMAFLFEVSWTRCLELHSNEYLINISLSSEQGDLGATSKSQRLLDAHPTSFYFRISKTKRVTEIQSQVVIQLQSLAVFPSPEDLCSQ

SEQ ID NO: 9064 - protein, 562 aa, Dinoponera quadriceps
MTRDISRRRIYLSTVYLLTVVVVVFSSSSVCSAAVYDGDTFVNMTKSSLKILGIFGHFGKSHFDVFKPLMEELARRGHRVTVVSHFPRSEDAKAKEPLPTYKDISIYDPDHGVYLDVVDIHMIKHNILQPAYELMFLSFMADMACKTGLRHPAVREFLRSDEEFDLIIIETFNTDCFLGFVHKFKAPYITISTHQIMPWVNSDMGNEDNPSYIPITLLGLNKPMNFLSRLYNMLSLSIAKVAYNCWFRFRDQSVANEAFGPDLPSLKEIARQTQALLVNTHNSLHGSVPKLPNIVEIGGIHIPTQVKPLPEDIAEFLDNAHQGVLYFNLGSMIKMSTIPREKLDVLLNVLGSIPRKVLLKWENEVLPRKLDNVMVKKWIPQFDVLNHPNVKCYLGHGGLLGLSESIYVGVPMILMPMFGDQFHNVAAAKNRGIAEMVAFNNLDEHSLRLALDKVFNDTSYSENVQRLSKAYRDRPATPLETAVWWTEYIARGNGGPYLHSYGADLAWYQYHHIDVVLVLIIVVALFVYILFRLIKLLSCLLHAVKEVYISATKPTNKWKKEN

SEQ ID NO: 9065 - protein, 510 aa, Biomphalaria glabrata
MLSLNQLLIMASIVSLEFCGAKNVVMIPPLSKSYLIYHAKIGQALIELGHNVSICVPDYLANKGLVPHKKINIIKYGEYLGDVEALVYEKTQLIEKFWAGGVETVGSLIPIVNFCKGLLEQILSDETFIASLRDLKPDFFIIENFMFTRNILVLPYKLDVPFGLIGTYHDYFLSRTPFSPAADQFFFDDGSDRKSFLQRVQATILSAAFTVYDMFSDGDVVSRYAPEKPDISIREIALKAEIFITEIDHILDYPRTSLPNTKLVGGSSVSEAKPLSGEIKHFVDKSPNGIVVVSFGSGNVYIPDQIRSKMANAFLKLNLNVIWKINGTFEQQDKILASNWIPQNDLLGHPKTKVFVSHCGKNGQYEALYHGVPILCLPMYGDQFYNSKRIAVKEFGHYADIREITSEKFSALIQEIADDPKYRNNIQKASKLFKELYKVPSKEAAYWFDHVMKYGGSYMRSSGQQMPLYQYLLLDVMAFLFGIVIVFLVVVSIIFRLCWKLLTKYKVKTD

SEQ ID NO: 9066 - protein, 509 aa, Octopus bimaculoides
MAALWWKMSSSIVWLFLITANKIAEADNILFLSWPLFSHAQGMSYVAKELSKYSHTCYYPMTEKLAERFKSFEGIKIIPMKNNPRIAYFEKLSTQQFLKNSNITWKMMSQEIHDICDSFLLDQEWFQSLKAVNATIAVVDYVFMSNCLTIIPYKLSIPYVFQGISAEHQAVTRIPWHASVFPNMLTLYTDQMNFYERLVNHILTVPSYFLPLLGNPAKSVKAYAPEKPEISFEKLMNQAALYLHESDVLLEFASPSLPNVKHIGGPATRPAAPLKGDLHKFVEKSNHGIIVVSFGSFLDTFPEGHLEKMEIAFKEIKYDVIWKHPAPKSIASNIFLTKWLPQNDLLGHPKTKLFITHCGNNGQFEALYHGVPMLGFPVFADQFHNGRRIQVKGYGISMDMFNYTKDELVSTINELIVNPKYKNKIKKASEIFRSRPESPAARGARYIDHVIKYGGDYLRSSCQTMPLYQFLMLDIYAVFLAVFIVSLCLVKFVIRKCYRCCCVKKKKMD

SEQ ID NO: 9067 - protein, 546 aa, Polistes dominula
MYLRWMNLCFYVYIVLCFICHETKSEFLDKSPEKKLKILGLFPHHGKSHFFVIQPIVEELARRGHEVTVISYFPRTNSSKVKEPLPNYKDISLVNENYVAAEDSVNLGKISHLPVVTLLKEVFFLSTRGKGSCENGLTNPGVLEFLHSNKKIDLIFIENFNTDCFLSFVHKYKVPFVGISTCQIMSWTNNHIGNPDDEANIPNVFTHFKTPMNFFDRTANLLWVHIQNIIYDLWYDYYHRGPAEKLFGSDLPRFADIAKHQSLLLTNTHWSLHGSRPLLPNIIEIGGVHLPSSVKPLPQDLAKFLDEAKEGVLYFCLGSMIKATTMPPARLQAIINVLRSIPRKIIWKWEDTNFTAKPDNVYISRWLPQYDILHHPNIKAYVGHAGLLGLTEAVHAEVPMILIPMYGDQYRNAAAAVHRGAAILLEYEELNEKIFRDALDEIFNNTRYRDNVKKLSKAFRDRPSSPLETAVWWIEYVGRGNGLAYIRSDAAEQPWYQRHLLDVILFLILLFLLIFYVIYRLIKFFIKRTNTKTEHVFDNKKWKKRD

SEQ ID NO: 9068 - protein, 487 aa, Bos mutus
MNMMSMKQLSFLMLLQLTCYFNSGNCGKVLVWPVEYSHWINIKTILDELVSRGHEVTVMTSSASILINTRKEFGIKFENFPVSLTKGDFEYIFKDLLEKWTYMEKDSFLSYFSAVQSLFWKYSDVSMKMCKEVVSNKKLITKLQESRFDVLLADAIGPCGELLAEILKVPLVYSLRFSPGFSIEKYSGGLSFPPSYVPVIMSELSDQMTFMERVKNMIYVLYFDFWFQTFNEKKWNQFYSEVLGRQTTLSETMGKAEMWLIRTYWDFQFPHPLLPNFEFVGGLHCKPAKPLPKVLWRYSGKKPDTLRPNTRLYDWIPQNDLLGHPKTKAFLTHGGTNGIYEAIYHGIPMVGIPLFADQPDNIAHMKAKGAAVSLDLETMSTRDLLNALNEVINNPSYKKNVMWLSSIQRDQPMKPLDRAVFWIEFVMRHKGAKHLRPAAHNLTWYQYHSLDVIGFLLACVATAAFVITKCYLFCYRKFLKTGKKKRE

SEQ ID NO: 9069 - protein, 504 aa, Biomphalaria glabrata
MICSVVALLELPDLFLEAKKIVMFPSPWRSYAIYHSIIAAALTEFGHDVWLCLPRQQSLEGLVRNERVRFITYEYEIDPFYKKLFAEELLKKDQDSVYDVFQPKHRHEIFLGQILEDTQFISNITNLKPDLFVLEMAKSSTNVVLIPYKYDIPFAFISTMRNPVKTRTPFNPILEPLIYLSVSDKMTFFQRVKLTLIYLTFLLCPSATYDKFVRQFVPEKPFLSINDIVLKAEIFLFETDHILDYHRPALPNTKFIGSSSARPSNSLTGQLKLFADESSHGFAVVSFGSVDIELGQRITDTMISAFEKIALNVVWKTNATIIRSRKILTRPWLPQNDLLGHPNAKVFISQCGKNGQYEALYHAVPMLCLPLHSDQFYNTERILVKGFGLGADLTSVTPEELANLINNVTYDPRYRSTIKKASNLFKELYKNSSKEAAFWFDHVMKYGGDYMRSFGQQMPLYQYLLIDVIAFIMVIFIVVIHVMYTTIRLIYYMFKNNAWKLKSE

SEQ ID NO: 9070 - protein, 389 aa, Lottia gigantea
MLNDSMLLSDIKEQNFDLMIVDSTPIAAMLVLIPYKFNVPFILCGAYYDPLALRVPFSPAVTPFEILENTDRMTFYQRFSSAMWHLHITYYSPFSYANAAGRYVPEKPNLCIVDIIKKTELVLYEYSILLKYPQPTMPNIVLLGDVTPSSDTQIPNNFKKFLDRSKNGVVLVSFGSLASAGDKPVFKKLVSAFKRTKYNYIIKGEFTQSDDQILAENWIPQSSLLKHANIKLFITHCGANGIREAIIGGVPMLGFPLFAEQPGNAFKMQSRGFGIKMDLYWDNEDDIVKSINEIIENPQYKNTVKRASEFMNAQKGNATLEAVFWIETILKFGGEYLRSAGVDIPLYQYLLLDVIFVLICIIIVVILIMYLICKCICNRMCSKTKTKRE

SEQ ID NO: 9071 - protein, 524 aa, Apis mellifera
MKYRNGIIIFALCFINIIDQLNGARILGVLHIPIYSHHVPFQPLWKELIKRGHEIVLITSKPISTINSTNFKQIKYNVDLKFIQSNYIELRMNRKSFISFMKDDVYIMLLHITNKIFEHPEVKKLYAPDSKEKFDLIMIQMLSAPGLYAFAERFNAPVIGLSAFRLMAIENYMLGNIVLPSHENTWEMESNTGSNLSFWQRLNNFYVMWNFIYTMNYRCFPAHQQLAEKYFGPSVSSIKDIMKNTSLVFVNENQIISYARPELPNIIKFHSIHVADHSEPLPQDLKTFVDNATNGFIYFSMGHTMNFSIISNSIQEIFYDVFEKLPYKVVWKYDKEPLRKIKNAYITKWLPQKSVLAHPNIKLYIYQGGLQSTQEAIYHEVPVLGIPIFSDQENQVKIAVNHGIAKDLNIETLTRDKLESAIREMINNKQYKKNIINLRKLMNDLPYDSLNILIWWTEYVIRHKGAPYFRSNLAWQSWYQYCDNDIIVFLSFTVFLIAYTIIKIIRKLISYMHKLSIDQKKKTN

SEQ ID NO: 9072 - protein, 222 aa, Cephalotus follicularis
LDSFDGLPSFRFETIPDGLPPSDDNTTQDIPSLCASVIKNCLAPFKHLLLKLNDASTSSNVPTVTCIVSDSCMGFTVDAAEEFGVPNVSFCIFSACTLICFLHYRQLVESNYTAIKGESNLTNGSLDSVIDFIPGIEGITMRYIPTFLRMTDPDDIVLKFIAIEVERMKRASGTIIHTYDALEHDVLCALSSMLPQVYSIGPLSLLANQIQDDDLNLLGSNT

SEQ ID NO: 9073 - protein, 232 aa, Helianthus annuus
MRTIPSSMGSTQENQPHVVCVPLPAQGHINPMLKLAKLLHSKGFFITYVNSEFNHQRLLRSVGSDALHDLPSFHFETISDGLPPPENPDATQDVSSTLNSLHETGLGPFKSVLSKVSTLYSPVTCIVADFLMGFTLPAAEELGIPAVLFWTSGAGSLICYDQYPNLIQKGLMPLKDFLHVQILKARRTWSMTRFGMKTRREGAQKMKMIELPLAIINTTRISLHKDKVFSRA

SEQ ID NO: 9074 - protein, 529 aa, Dufourea novaeangliae
MKSITSVVFLVLCIFAAVQQLQSAKILAIIPTPSYSHQIPYRQLWLELHKRGHEIVLVTANPIPGMNATTFRQIDIGTSYGIIRQMDFVKFRFEGLDWLAFEENYLFDFSDLMANEVLNHTDMKRLYEPNSNEEFDVVMAEMLLVPSIYAFAHRFNAPMIGLSSLGLLAFNEHVLGGIVLPSHEYTWEMEANVGLQQPFWKRLWNYVSLWRSIYKVHHNLLPRQQRIVETYFGPSVPPMLDILKNISVIFINQADPITPAKPKLANMITFTSFHVSDNLTPLPEDLKRFMDNAKEGFIYFSLGSNAMSSDLPKETLQVFKDVFSKLPYKIVWKFEKDMPGKPDNVFIGKWLPQQTILAHPNIKLFIYQGGVQSSEEAVHFTVPLLGFPVLADQDYQVLRMEALGVAKRLEITTVTRDELNSAIRELLSNKVYKERMIELKKKVNDNPYDMVSHLVWWTEYVIRYKGAPHLRSSLVDQPWYQRCDMDIVVFLTVLSVLIISNVTGIIAKLVVRSYKQYQVLSGTQKQKIS

SEQ ID NO: 9075 - protein, 444 aa, Eumeta japonica
MMKEFGKEVDFFTSQHRLWSIMNAYTEYILNAEELKRFIEEDNSKFDLVIAEEFFQQIFYVFSYKYRAPLILLSTFGVGHYMNEYMGNSMEISYVPHEFFAVSGDMTVFDRLKNLAYTLYDILARRYYSLAFQNELAKSVFKNLGEIPNLEELERNASLLLINAHYSTSIVRPYVPNIVEIGGIHMDAVKNLDEDLRRLLDEAKDGAVLFSFGSVMDLSRQPRESIAEVLAALGSIAQTVILKWNSDEPLPILYGNIHPYKWIPQNDVLAHPNLRAFVTHGGLHSAMEAIHHGVPTICVPFFGDQPLNCLKSAKMGWGIALEKKNLDQNVLRTALNEILHMKSYQNRARELSVVFKDRPIDVMNSTMFWIEYASLFAVGCFPSEEVKMSISHTLAPVRVGSVGLKPTKKVPLKMKWLDRLCYVVGRLYNFTESGRTTHVGADGA

SEQ ID NO: 9076 - protein, 521 aa, Halyomorpha halys
MKYTLPIILLVTSFLGLEGAKILIALPIPWYSHTMTFMPVFKELAKRGHQITMVSPFPQKKPLPNWTDLPLNITLMVAAMDHHLANKVTSGHNMYTFYPVGWNFFMRIMEVAFQDRTLQEVIKSENLDYDLVITEPFYGVEPLVALGHKLSVPVVAIHPLSFTPWGSYLSGNELSFHLMPNIRTTYTNEMTFFQRLNNVLVNLIEFSIAYFHYIPNKERQMEKYMVYPGSENRPPLLSMLRNVSLTLLDYHPSILYAEPLQPNTIPVGGLTLSHVDELPKDLKDILDNANNGAVFLSFGSLFRGKALESRVLSVLFETFSQLNLVLLMRWHTEDIPNKPKNVIIKTWMPQPSILAHPNLKLFITHAGLHGITEGAYFGVPLICMPLFSDQEYDSRFVEKAGFGTVLLLEDFNKENLLANINEVLKNPKYRNIAMERSKIIKDKPQSALESAVYWVEYIIRHKGADHLKPGRLQDFEINSFTCKRLVILVSPDYLNLNIDFFEISSTDWIYILKYISGNVTE

SEQ ID NO: 9077 - protein, 540 aa, Athalia rosae
MTSPAKLFCLTSCVVFLMSSWRSEAAVRNEKFKILGVFPHPGKSHYDVFAPLLEELAHRGHDLTVLSHFPRKEKLPNYKDISLVGETGIYLNVVELSMLNHGPFHAMYELAMLKTMADAGCASILEKPDVKKLINSDEKFDLVIVEAFNTDCPLGFVHKFKAPFIGISSSQIMPWTHHRLGNPSNPSYVPVILKQLAPDMSFWERVTNAVHLVAVRVAYDLFFMRQTQVLVEEAFGPGVPPLDEIAKNMSALLINSHFSLHGSVPTSKQVVEVGGLHIRGSKPLPKHIKDFLDSAEKEGVLLFSWGSMIKTSSMTKELLDMIVKVLANLKQKVIWKWESDLPNLPKNVMIQSWLPQYDILSHPNVKGFLTHGGLLGVSEGIDRGVPMLVVPMYGDQGLNAAAAAARGAAIILQLEDITEKTLSDGLNEILNNPRYRRDAKAVSEAYRDRPSSALETAVWWTEYVARGKGVPFLPSVATHLSFVQYYLLDVIAFLLLATSGVIFIIFFAIKALCGRKVGGSATTAGKSNGVKKSEIDKKRV

SEQ ID NO: 9078 - protein, 520 aa, Trichogramma pretiosum
MLINKLILLLVTFEVIGCCSAYRILGIYSLPIKSHFIMINQLFKGLIEKGHNVDLINTFPLNENNTSYKQIMTLPDHSVLTSKTLRIDEFVVNFNSNYSLMGLLGNAICKNIGHPELLKLAENPPKDPPYDIIILHMMNYHCYMILAHRWNIPVVLVSTTAMYPWMHDMIGNPENIAFSPNNMKTVPEGNGFWARLVNAYIFYRLKFSYLHQTQYQSDLLKKYYGPDAPNIRELEQSVSLVLMNTYFPINGVKPLTTGVVEVGGLHIKNDGLELDVDLKKWLDDSKDGVVYFSLGSMFRIETFPDHVLDIILESLRKLTPVKVLMRIAKLEELTKKLPSNIHTLPWIPQEKVLNHPNVKAFITHGGLLGTQEAVFYGVPMICIPLLADQWTNAQNYVRLKVATVVDFRYMTQKEFDQAIDNILKTREYGENVKRLSKLFRDRPQSPLSTAIYWIEYVIRNGKNSLRSPAMDLKWWQISLLDIFFVTIIMPLVIFALFIIFFIRFIKRLISFKRSESKKRR

SEQ ID NO: 9079 - protein, 524 aa, Trichomalopsis sarcophagae
MSREREAEINNNGQEPLRSIVTVMDLRSIFLFLFLGLSVSDGYRILAIFPFDGKSHFGVLNSVVKDLASGGHQVDVMSNFPPKESFPNLTHIVTLPVAGAQSRIDYNLIFYPEKEANWLHDKKRRMCDFLGLPKVAELIRNPPTNPPYDLLLVHVLTGYQCLAAIGYKWNIPVVGVVTTTLYAQMHHIIGNPLNLALTTSHFGFYKKKLDFWDRVHNVVQTYRVISKFYGYAKDQDYYIKKHLGNDMPSYRQLEKNMALMFTNSHYTYHGVTPKTPGLIEIGGINIKNDTSELPADLKKFLDKSKDGFIYFSFGSLVVIETLPHEALERFYSAIRKISPVKVLMRVPHPDDMPKNMPDNVYKFSWLPQQTVFQHPEIKGFVTHGGAVSTQEAVYYGVPMICVPFFAEQFINCDILSHKNSSLTLDIYRNQRLTQDDYDHAFREIITNPTYKESVRKFSRVYRDRPLSPKETLLYWTEYVIRHGKNILKSPAVNLEWYQSDLLDVHAFLFTLMTKTSKKSSKKIN

SEQ ID NO: 9080 - protein, 211 aa, Helianthus annuus
MEKPHAIFIPYPAQGHINPMMKLAKLLHLKGFHISFVNTHYNHKRFLRSRGPSALDGLPDFRFYSIPDGLPPSDADSTQSSPDLCVSIPKHCLEPFCELITRLNDASDVPQVTCIVSDGAMSFTLKAAEKFGLPDVLFWTSSACGLLAYAHYRDLIQKGYIPLKGTTYCFCSRVMHACSFGRSLFNLFGKIENHVLESFYLRSLKIEYKYF

SEQ ID NO: 9081 - protein, 358 aa, Rhopalosiphum maidis
MVVLIVTVISVIITVTVISPADTANILAVFPHEGFSHHLVYLPYIQELANRKHNITFISNYPIEHPNINNLSIRGSIPLRNNKENISSFENKSMNEIMQSINIIWMFNKRGKVHEAMFTDIQKYIDEAENGVIYFCMGSLLRGETFSAEKRQMFLNVFNKIPQRILWKWEGELPGKPSNVMIRKWMPQRDILAHPNVKLFISHGGLLGTTEAVYEGVPILSMPMFGDQITNIKTLINKGSVEMMNYNDLNEDEIFIKITSMLTNPKYRLKAKELSEAFRDRPMSPLETAVYWTEYVIRHKGAPHLRSAAVGMPWFQYYLIDVFIVIFLSVTTFFVLLYCLVFKVLLRLLNRKSKEKKS

SEQ ID NO: 9082 - protein, 573 aa, Copidosoma floridanum
MNWSRKLVISFALLSLSVVSLSSGYRIFAMIPFKGRSHFKVLEQVVMALTEKGHQVDVISGYPRTEPFPNYTDVVKLQSTQVKVSVDYSELHSRNGIKEAVHSTCLELCDLLGHPEIARIVKNPPKDPPYDLVLTHFFAGYQCYTGVAHLWNVPLVGVVTTAMYPYNHRMIGSPLNLAIASKNLRSHNDKMSFWERLYNVLMTHWEIYTYDMRAYKQDALIKKYLGPDMPSYTELEKSVSLMLTNSHFSFHGVQPNNPAHIEIAGIHIQDDNTTTMSEDLKKILDDSKDGFIYFSFGSLMRLESFPEEVFGKFYSVFRRLAPLRVLVKSVDPKALPKGKPNNVFTFPWFPQEEVLKHPNIRGFITHGGGLGTQETVYYGVPVICVPLFADQHINCDIATNKKFGIKLDVVAAQQADFDRAFNEILNNPTYRESATKLSTVFRDRPLKPRDEAVFWIEYVIRHGKNVLRSRAVDLKWWQAELLDVYAFIAASVAVLLGCLVFFAQLLIGSFIRKMRKFSLSVNSRRSKKVPAMVDLIDDNATCAYRDIQKITEASGQLHCESKRREPEYTSHTR

SEQ ID NO: 9083 - protein, 350 aa, Sulfobacillus thermosulfidooxidans
MRILIASLPIGTGHDIAAKALAEACLKLGMEVEFSEHLVGKARIETGLYFWALKYIPRQYGYIFRWGDHSPLQWAKHRQRWMRIGQEILNHVYDLYEPDIILATHPFALNAWAGVKEIHSHLKLVGVLTDLSVHRFWYEPLADAYTVWLPEQVEDLARFGVKKEQVWQTGIPIRSSFHEPAWELPLYAKDPIVLLGGGLGMGPYYRILRKLAEADYPVVAVCGHNERLRWHLDQYSWPDVVTIVGYVEKMPLLLHHSRLVVGKPGGVTAAEVAQSHVPFILTHWIPGQEEANRDRLLLHDMAVRGDKDLLKWVRNILPEESPLRRKIIHHQELWARPHAASDIANRLLNL

SEQ ID NO: 9084 - protein, 389 aa, Syntrophobotulus glycolicus
MFEPRILIVSSKFGGGHYQAGEALAEGLRSMLPKDAQIRHCDYGSFFPKGTDFLMRTAYLKMVKNTPSIWGKIFKYTNTTHAENKYRNFVKGFRQKSFIHYIREMEPDIIVNTHFMSAGVLAELKRKGLIKVPLVTVVTDYVIHGMWIHPGIDLYIVGCRQVQEKLIEAGIKEESIMITGIPIRLEFEQDLDKEELRKKLGFDPNKTTILFMGGAYGPTSKATEIIKAINRLNPRLQLQFLIVAGKDEEYYQALKQSEKECLFPLKCLGYVNYVEELMAASDLLVSKGGALTISEALTLGLPILMFKPIPGQEDGNAEFVESTGGGMTVLSSEELTRVLQYLSQNPGILREMSKLAGSALPNCSSQKAARAIINLREKERVSKEQVIGG

SEQ ID NO: 9085 - protein, 397 aa, Bacillus bataviensis
MEMNSKKKDKILILSASFGDGHKQVANALSEAIQFTLPNVEPVTIDIMEWLHPYLFPISHYFYNRVIKKFPQVYSYFYKRTREKSSFSVKLNTFFTLGMGSMLNVIEKIQPIVVVSTYPFAAGIMSKLKEHGLVDIPTVTVITDYTDHSYWIYPFTDHYIVGSKQVKDRLVSLGIEGHKINHSGIPVLKKFMNTQSREVLAKTYHLNPSQFTLLVMGGGEGFIGKGISTFQALENLSSPIQIIIVCGRNKKLRNQLEKELRNTKHHILLLGYSENIHELMALSDLMISKPGGVTTSEALTMELPLLLYHPLPGQEEDNAQFLVDTGLALLAKNDFDLIGKIEVVTKDVKSLNRMKQRARQYQSKTSSVDALDIIMQTRNQVYEQKSAFIMMPMRQSV

SEQ ID NO: 9086 - protein, 370 aa, Bacillus methanolicus
MNKKVIILSECIGNGHTKAAEALMQGISHLAPSIHTQILEAGQVLHPITTKLLVGSYLKMNSLSPSLWRKMYHYKHNVPLSNWKKFIIYLMFHRQIEDLLEQEKPNLIICTHPFTTSSISRLKRLGYPFTLCTVLTDFHVHGAWVHSEVDVYLVSSEDAYNQLINMGVPKNHIAVTGMPIRSNFWIKKNKQEMRKKLRLKNIPSVMVMGGGLGLGGIKELSHALLKWKENIQIIICTGNNETLRRTLSRNEKFHHPHVRILGFVDLIDEWMEATDLLITKAGGLTCFEAMSKGLPMYIYQPFPGHEEKNCEFLVNNHLAIKIDDITNLDKVIEKLLFSPEEMKSLYDRMRKFQLKIDPLASAEFIVNQFL

SEQ ID NO: 9087 - protein, 413 aa, Paenibacillus sp.
MRSIYEQKIIILTGSLGEGHNQASKAIVESAKRKYPHLRVKVIDYMELTHPRLHVAGQFFFVQWMKHFPSVYGYLFQKTREENTLIQMLKRFSTFSLQKLSAMLEIEKPAIVVSTFPPAAAGMSLLKAMGYTDVPTATVMTDHTDHSYWIHSHTDYYMVGSDVVQVALERKGVPSEKISVTGIPVNPLYSQPVDEERLRDYYGLKPSEQVVLIMGGGEGMIDKEIIELLKSRAYPQDVRFMVVCGRNMKLYQSLLEEFAEHPQITVMGYVDRMHELMAMADLMVTKPGGLTISEALTMERPMLLVKPLPGQEQDNADYLVGIGVARQAMAGELQHQFMTLMTDSSLLQEMKRKAAINTHKDSALSVLTRLIEIQRRYRPSREWAEEKNPVPYEVLNREVYVNEALHHYHDSYR

SEQ ID NO: 9088 - protein, 495 aa, Ktedonobacter racemifer
MKQRTILFLIADTGAGHRSAANAIHNAIKLISQQEQEAWQAQQVNQHTDSETTGATSKATNSLPEPTNYRVEIVDVFEEYSRFPLREAVKLYGPTIRYNPKLFGDVFHLSNQEGTVKAVQTLATPLILNGLMRLITSVQPDIIVSIHPLLNHVTVHALQELGLKIPFLTVVTDLVTVHYTWFAEGADAYIVPTEEAKRLYLQRGLDPKRLHMLGMPIDPKFTLPTEEKEALRKRFNLQDDLPTVLLVGGGDGAGGLQAAVKAISQARLPVQLMVVTGRNRRLYAHLQRTRSNFHVPAKIFGFVHNMPELMRAADIIVTKAGPGTICEALSCDLPIILSGYVPGQEEGNVEFVLHNDLGVLALDPRTLVNELRKLIKPGSEILQRRLANARNISRARASFDIAQCILSYLPVPETGSIWQSRQWQRQQQRLSGRLRSSIRIRRQGVRVRRPVISKTLLRNPVMRRFARTRDISENSTTQDTSSTERAVKRFRGLRR

SEQ ID NO: 9089 - protein, 382 aa, Unknown
  Description of Unknown: Desulfitobacterium hafniense Y51 sequence
MSNLRVLVISAAFGAGHIRAAEAVIEAIWAKRPNTEIYHADFGAFLNKAFHLVIKTAYIDMIKYTPKLWGEFYYRTSDIPSDSLFQRFLNGLGRQEFISYIHSVQPDLIVCTYPTIAGVLAQLKEEELLTVPLAAVVTDYAIHNQWVHQGVDLYLVGSQEVADGLAQRGIDPGCLKVTGIPVSPKFEIKLDREELVGRFGLDPGQPTILVMGGAYGVLDNASGICRLIMQNKLPVQLLIVCGRDKRLYSTLEPLVRKAENRVLLFEFVENVEELMTVSDLMITKAGGLTVSEALTKQLPMVIYKPIPGQEKANSEFLRRVGTGKIAATEGELLQILTHLLENPEEIKIMSHAAAKLPRRTAETAADYLLELFRQRNRVRKVG

SEQ ID NO: 9090 - protein, 399 aa, Peptostreptococcus anaerobius
MKKVLIMTASTGGGHNRAAKAIIEDIEALRYKDQKIECKIIDSFKLVNQTMDKIISDGYEISAKYTPTAYGKIYNISDKKFFSYNEFKNNPLSFIMAKRFKKLLIEEQPDLIIGTHAFPLVALSKLKKGYDEFPPLVSVLTDYTAHSAYLQDEIDYYICGDEFVKELLIEDGIEEEKIKPFGIPVEKAFMESRDRDIIMNELGLDPDKKTVLLMGGSFGAGNIKNTLDELVGIERDFQILVIAGRNKSLKRSLDERIKSYNTDINIKVIGFTNIMNDILTIVDILITKPGGLTTTEALLKEVPMVIPYFIPGQEGENLDFLTNCGVAIRTTKKFSIKSVVKVLIDNPERLERMKDNIRCIRKNYSSYNIALLSLDIFENTSVDYDNFLNRNRLLELFDL

SEQ ID NO: 9091 - protein, 400 aa, Paenibacillus dendritiformis
MYDRGYGKQPKEKVLVLAGSLGHGHLQAAHAIREAARTWYPQEAEVHVVDYLEQVSPHLHTVGSYCFVQWLKMFPNMYGFLFEMTRRDHRFSQLIKNVPLTSLRPLIKLIREVQPTIIVSTFPAASAAVSRLKERGAVQCGLVTVITDHTDHSFWIHPHTDRYLVGSEEARAKLAGQGIPACRIEVSGIPVRPEFYGNYDKVALRRRYGLDPDRMTVLLMGGGCGLLDPDFFRAMEEADWAADMQFIVICGRNERLQRHLEEWAASSSLHIRVEGYVQPVHEYMAMSDLLITKPGGVTTTEAVVQRLPLLVYKPLPGQEQDNIRYLVRKGLACQAEDPEDLVSQLSSFASRPEALQWMSVRAQAERQHTQARVLEAILQVERHPIVPRKTARLRFRRNYV

SEQ ID NO: 9092 - protein, 381 aa, Pedosphaera parvula
MRVLIATITAGAGHLQAAAALDEAWRAMRPKDVVEKVDLQKFFSPLHKTVHSAGYVKLVEHAPDLWAMLFKKTDNPKLVRRLTKFRRAIPPASTLRTIKYIKKFKPDVVFCTHYLPVEVMWRAKEKWEGKPPLVATVVTDFEAHALWMGPSSDFYCVAAEETKARLVARGAVSENVIVTGIPIAGKFSSQINGAEVRKRYGLRDDLPILLVLGGGFGMGPVAEILAELDKVPQQFQTLVVAGRNEELRRELAVQDRKHPTHVLGFVTNMHELMSVSDLVISKPGGLTSSEALAMGKPIFILNPIPGQEAANSDFLLERGAAAKVNRVEDLPYRMGQLLGSKKMVEMAQCAKALGKPSAAMDICRVTLERLEAGSGKRVSAD

SEQ ID NO: 9093 - protein, 381 aa, Paenibacillus sp.
MEKKRVLLLSEGFGTGHTQAAYALSSNLRKLSPDVQTKVLELGSFLNPKVAPLIITAYKKTVTNQPKLFGYVYRHQYKKSLNRLTTLALHKLFYTHTRSVVRQLRPDAIVCTHPIPSAVISRLKRLGVQVPLCTVITDYDAHGTWINREVDLYLVSSDEVKSKLMLRGVPADNIRVTGIPVHPNFWEHPGREEIRSRFNLKNMPTVLVMGGGWGMLSDKLVHPLLTRWHEDIQIIFCLGRNDKTRISMEQNPMYRKENIHIMGYTNEVDKLMEVSDLLITKPGGMTCSEGLAKGIPMLFHNPIPGQEEENVHYFTARGLGEPITSPDVVVKWMNKLLHYYPDVVRKRHLAEIAKVHPMQSAQSIIDLLEDVRPSSAEEAHL

SEQ ID NO: 9094 - protein, 371 aa, Bacillus methanolicus
MSKKVLILSEAIGSGHTKAAEALMQGISHLAPSIHTQILEVGQTLHPLTTKLLLNSYLKIIIRSPSLWRKMYDYKQNKPLSNWKKFIIYQLFHRQIEVLLDQEKPHLIICTHPFTSSSVSRLKRMGYPFILCSVITDFHVHGAWVHSEVDVYLVSSEDVYNQLINMGIPRSRIVVTGLPIRSNFWVKKNKQEMRKKLKLNNIPTVILMGGGLGLGGIQQLAHALLKWKEKIQVIICTGNNETLRSSLLRDTKFHHPHVYILGFVDLIDEWMDAADLLITKPGGLTCFEALSKGLPMYIYQPIPGHEEKNCDFLVNNHLAIKIDDTNNIDILIENLLFSSREMEFLHNKMREFQQKIDPLASAKFIVNCLIP

SEQ ID NO: 9095 - protein, 388 aa, Paenibacillus polymyxa
MNNIKREKLLILSGALGDGHMQAAKAILEASVLYKQGVEVVDFMQWIHPRMHVVERYCFLQWVKHFPSSYGYMYQKTRTDSTLTFFLKHFLTTSLQRLLKLLNEEQPTLIVSTFPLASAAISLLKEKGMTDLPAATVITDHSDHSYWIHPFTDLYLVGSEGVRAALQRKGVADHKIAVTGIPVRPSYSQTDNKDRLREKLALPLDAFVVLVMGGGCGIIDKSFIEQMQSDSFPPNVQFVIVCGRNVKLLNRLHEALGDRDNVMLTGFLEGIHEWMASADVLITKPGGLTTSEALALQLPMLLLEPRMGQEKDNASYLIQAGVAYLCQNDNLEDQLQRLVQQPSLLEEMRENAGLCRQQDSARHAVMQILSMQSDTQEEKWVCSLQQYA

SEQ ID NO: 9096 - protein, 388 aa, Intestinibacter bartlettii
MSKKVLIMSASTGGGHNRAAKAMKEEIEKRCINGEYITCEIVDSLKLINTTMDKIISSGYEKSAKYTPKAWGGVYKISDANIMSKHEFKGNLFNSLLSSRLKKLLKESKPDLIIGTHPFPMIALSTLKKKYPYRNAFNSFFVPPLISVLTDYTAHSAYIQDEIDYYIAGDEYVREVLISEGIEDDKIKPYGIPVEKSFLEHRDKNVVLEELGLESDKFTVLLMGGSFGAGNIKDTLKELLLIDRDFQILVITGRNESLKERLEKSLEKSSFDKNISVLGFTKDMNDILSAVDIIVSKPGGLTTTECLLKELPMIIPYYIPGQEKENLDFLSNCGAALRTSSKFTLTVLLKVLIDNPERVELLKNNIRAIKKQNTSEDIADLVCEIIGQ

SEQ ID NO: 9097 - protein, 391 aa, Staphylococcus massiliensis
MVTQNKKILIITGSFGNGHLQVTNSIVEQLNTLNLDHLSVIEHDLFLEAHPILTSMLKKWYINSFKYFRNMYKMFYYSRPDAVNSCFYKYYGLNKLLNLLMKEKPDLILLTFPTPVISVLMEQFNINIPIATVITDYRLHKNWVTPDIERYYVATKELKEEFHQVGIPQDNIKVTGIPISEKFEQDIDTRQWLKDHKLDPDRETVLMSAGAFGVSKGFDEMITSILRDSENSQVVMICGNNKELKRSLRASFAGCHRVLILGFTKHMNEWMASSNLMITKPGGITISEALTRKLPLIFLNPAPGQELENAYYFTDKGYGKIAQTPKEAIDIVTYLTNHPKQLAQMTDKMAENRISYPTQRLCNDLLSLLSKSSQHDEMYGKVPLYAKILLK

SEQ ID NO: 9098 - protein, 379 aa, Paenibacillus sp.
MRKKRILLLSEGFGAGHTQAAYALSSNLRKLSPEVQTKVLELGSFLNPKVAPLIVSAYRKTVTSQPRLMGYVYRHQKSFNRLTTLALHRLFYTHAQNIVKQLKPDIIVCTHFIPGAVISRLKRLHPSLKAPLITVITDYDAHASWISPQVDRYLVSTPEVKAKLRRRGVAAFKIRVTGIPVHPSFWEQHGREDIQEQFKLLGVPTVMVMGGGWGMMNDEVVNAALAGWRDKVQIVFCLGQNDKLLQEMMQDPRFRHPNIRLLGFTREIDKLMEVSDLLVTKPGGMTCSEGLAKGIPMLFHSPLPGQEEENCRYFTAAGLGEPISSLDVVDRWMERLLNDYGNVRAARKAHLEAISRYNPLQSAQSIIDMLDKPRAEHGE

SEQ ID NO: 9099 - protein, 383 aa, Syntrophothermus lipocalidus
MLSISARHAQTYGKTRVLILGAAYGAGHLQAGLALQAALAHIRPEWEVKTCNFVEMVSPAFDVFSRKFYLFMVRHFPLCYQWFYHLTDAVKPRKGYLLDRFGCRRLQGFVDEFGPRVVVATFPTPGRVAATLKLEGKSQVPVVMVITDHTVHSEWIHPGVDLYLVPDEGVREMLLKRGISSHIIRVSGIPIRPGFADNLNQTAARHHLGLDEKVPVVLLVGGGNGRVTAMEEICAGLSRLRLGMQVLVITGEDVTYRERLCSKFEGDPRFRFYGFVNNMAEFMTAADVLITKAGALTLAEAASAGLPVIIYRCLPAQEEANALYYAQHRAALQVRNQEELLLSVEKILLDRGELAASLSAAIRKLARPRAAFDAACAIAELVE

SEQ ID NO: 9100 - protein, 390 aa, Roseburia hominis
MNVLILSCNTGGGHNAAARAVAETFRAHGDEAVVLDYLKLAGEKVSRTVGNVYVETVKIAPGLFGLLYKIGMLVSRLLRRSPVYYVNGKMAVYLAAYLKKHPADVIVMPHLYPAETITYMKRKGMKLPLTVAVMTDYTCIPFWEETDCDYYMIPHESLIPEIVKRGIPEEKLVVTGIPVAAACSEPWGGTPEESAAADTHAHSIVRKKVQQAAKKSLGLEEKQRYILVAGGSMGAGSIDRLIPALLRRIQGEEHLILICGSNQKLEQRMQARFGRDARMTILGSVSNMPVYLHACDIIYTKPGGLTSTEAAVTEIPIVHTKPIPGCETKNRSFFVKKGMSVTAYTEYGLVRKGMQLLHNPGKRNAMQRAQCQGMEKHSAEKIYQFVKTKI

SEQ ID NO: 9101 - protein, 370 aa, Brachyspira pilosicoli
MKKILIISSEYTGHGHKSVHTALIQGFEKLYKDSVEIKVVNGFTLGGPDLLAAERLYNQCVKYFPKLWEKIFKFSFKNKDFINKNNSITIKRSFLKIYKQYKPDLILNVHPLFSGSLLNIIEKKKLDVKFFILITDLITITKIWFDNRADKIISPSKEATEYMIKNGIDREKLITFGLPVRNGFDAPFASKEDIIKNTNINGKLKILILNNSEKTKRLLYIIKNLYSRYNCEVTIICGRNKHTYNKLNKFYASRSYSPQIIGYTQNIAKLFHDNDILITRSGPTAIIEAVNCIIPIVSMGALPGQEEENPIYIQQNGLGLDSKSTDDIFNKIDLLIANNRENLVKMREAQFDYYGRNVRDDIVKYLADNI

SEQ ID NO: 9102 - protein, 371 aa, Parageobacillus sp.
MSKKVLILSEAIGSGHTKAAEALVQGISYLAPSIQTKILEVGQTLHPLTAKLLLNTYLKIIVRSPSLWRKMYRYKQTEPLSNWKKFIIFQLFHRQIEVLLHQEKPHLIICTHPFTSSSASLLKRMGYNFTLCSVITDFHVHGAWVHQEVDVYLVSSEDVYNQLINMGIPKDRIVVTGLPIRSNFWIKKNKQEMRKKLKLKNIPTVIIMGGGLGLGGIQPLAHALLKWKEKIQVIICTGLNKTLRTALLRDEMFHHPHFHILGFVNDIDEWMEAADLLITKPGGLTCFEALSKGLPMYIYQPIPGHEEKNCDFLINNHLAIKIDDTNHIDILIEKLLFSPQELEFLHNKIREFQQKIDPLASAKFIVNQLIP

SEQ ID NO: 9103 - protein, 387 aa, Desulfotomaculum reducens
MLNKILVLSVSAGEGHMRAAAAVKEEIIRRNSKAEVIILDTFRYASPLIEKVVLGTYMEIIKMSPIIYGYLYRQAEKEKPFSGFAKNEFNRIMNRLAAPKLVTFIDQMQPQAIMCTHPFPLGILTHLKSVGKCKVPIIAAITDFTVHPFWLFNDVDYYLVAVDPLVKSFAEHGIQYNKIKATGIPIDPKFAIPKNKSVLRYRWNLEPDLPAVLIMGGGLGMGPLGDIVKELASSGLPCQMVVVCGRNEQLRNKLIKLQPTLSRKVEVLGYINNIEDLMATCDLMIGKAGGLTSAEAMATGLPMFITDPIPGQEERNAEFLESMGAARLVRGQKDLVHRVKEFLSNVAIQKSMADAAKQIGRPRSAEAAVTVMEELCATYKTKHMVSE

SEQ ID NO: 9104 - protein, 370 aa, Paenibacillus dendritiformis
MQKKILILSELFGSGHTQAAEALAQGIAQLEPSIHTQIVEIGKMLHPTRTAILFRSYKKLITMYPLLWKKIYESKQNQPVSQWLQFTIYQLFHRNMEQMLDQIRPDLVICTHPFNSSSIARLKKRGYPINLCTVITDFHAHGVWVQPEVDLYLVSDEDVHQQLRQMGIPNYRIAVTGIPIKSNFWNKTDKQEARRRLRLKDLPTVMIMGGGLGLGGIQELAHSLIKWREFVQILICTGYNESLRCALQSNAHFQHQHIMILGFVDMIDTLLDAADLLITKPGGLTCFEALSKGVPMLIFQPIPGHEEFNSNRLVNQELAIRINHQDEVDHWIQKLLSSPEPFEFLQSNMEHYQQKINPLAGARSIMKLLS

SEQ ID NO: 9105 - protein, 395 aa, Paenibacillus sabinae
MRKKRVLLFSEGFGTGHTGAAYALAEGIKRLNPAVQCRVIELGKFLNPTVAPWILSAYRKTVSSQPKLVGMLYKTQYHRSLNRFTKLALHRVFYTHARQVIEQLKPDLIICTHPLPAAVVSRLKHLGLNVPLYTLITDYDAHGSWVNAEANRYLVSTSRVKSILTGRGIPADQVTVTGIPVHPKFWERSSKETLRQELGLANMPTVLIMGGGWGLMFGEEIMNALTAKIDQIQLVFCMGSNNKLVEKLRSDPRLRHPNVTIIGYSSDVNKLMDAADLLITKPGGMTCTEALAKGIPMLFYQAIPGQEEKNSQYFVELGLAEMLDSEKVVDKWFRLLRREYAELEEQRRRRLSPDRYQPGNCAATVLEMLGNPKDLSGSLSAQSQPCPDEAIYLTP

SEQ ID NO: 9106 - protein, 452 aa, Ktedonobacter racemifer
MPFSEEGISPSVVADFWEGGALLVSTLQRTILFLLADTGAGHRSAANAIGSAITLLSQEEHARWSESMRREMQPSVDGYEYGCLIDTFSPPNYRIEIVDVFEQCSRFPLREIVKLYAPMIRLSPQLHGKFFQQMNHEAMVKAATALGSPFIQSGLHHLMSNIEPDIIVSVHPVLNYITLQVLRKLGVPIPFVTVVTDLISVHTAWFAPGASGYVVPTEQAKAFSTQKGIDASLVHVIGLPIHPQFTCTTKQENDISERLGLIPHLPVVLLVGGGEGAGGLYTAVRAISQARLPVQLLVVAGRNEELHTRLQRIRSRLQVPMHLFGFVENMPDLMRISDVIVTKAGPGTICEALACGLPIILCGHIPGPESGNIAFVEHNAVGILAQRPREIVDELRRLLQPGSLLLPHRRENALRLSRPHAAFAIGQYILSHLPPPDQPSLWQRRRVSESKA

SEQ ID NO: 9107 - protein, 382 aa, Thermosediminibacter oceani
MDCKKVLILSEKFGAGHERAALALSKGIKNISPDTEVKVINFFQYFHPHVSKVTLKMYLSAINMKPEIWGYFYERERNKKKAGLAKKLLRSAMYFFLREILDKERPDVIVCTHPFPACVASRLKQKGLETPLAVVITDFDVHGFWINDHTNAYITADEFLLKPMLDFGINPSIIYPTGIPIDPNFHREVIGTDAKRALGFREDVPLLLVTGGGLGLTVLDEYTVKQLASATVQLAIICGKNPPLREALRRIVAENHLDNVRVLGFVRNMWDYMGAADLLITKAGGLTIAEAISKELPIVLYNPLPGQEERNAAFLLKKGVAKKAQNQKELVDLVKELTRNKHLIQTMKRNAAGLKKTRPAEKAADIVLSLADHGNKTALISF

SEQ ID NO: 9108 - protein, 380 aa, Burkholderia cepacia
MSKQNKKILLLSVSAGAGHTRAAEAIRAFADHHPAGIEATHLDVMDFVSTGFRKLYTDLYIKLVSSQPALWGYLYQKTDEVDPAAPSQKIRRAIERLNCRALLAEIERQRPDAIICTHFLPAELLSREIRKERVDTPVWVQVTDFDLHSMWVVPNMRGYFAANDEIAWRMHARGMAPETVHVSGIPIMPAFGQPLDRAACAAEYGLDPARPTFLMMSGGAGLGGLDVLAARLLGMDADFQLIALAGKNQAMLASLQELAAQHPGRLFPQGFTQQVERLMACADLVITKPGGLTTSECLAMQLPMIVNSPIPGQEERNADFLLEQGVALKAIDDDALVYRIRALLQAPERLADMRRRLAPLGRPLAGRFVLDRVLGLEPAA

SEQ ID NO: 9109 - protein, 384 aa, Ruminococcus gnavus
MKVLILSCNTGEGHNYAGRALKECIESHHDTADMLDIMMLASPRVSKLVGNSYVNIVRHAPRLFQCLYKLGGLVSSARHHSPVYYANALLAKKLTRYLDTHHYDVIVTPHLFPAQTLTYIKKKNLLSQKVVAVETDYTCIPFWEETDCDYYIIPHYELIDEFTAKGIPRERLKPYGIPVRPAFSDQSDRQKARVRCGIPTHAQVYLIMSGSMGFGKIQLFVAELLRTRKPGEYVVVICGNNRRLQKILLAEFGKQEGVQILGYTEKIADFMAAADVLFTKPGGLTTTEAAVKGIPIVHTRPIPGCETKNLAFYTERGLSLTSQKLHGQILAGRKLMSNDELRHSMCTAQHTVIPPNAAEKTYQLLCQLSSAYAVSDDTAKKETL

SEQ ID NO: 9110 - protein, 403 aa, Paenibacillus dendritiformis
MQEPVTWTVPAGFAFANDNEGKKRVLVLSERFGAGHTQAAHALAVSLRKLSPHVQTRVIELGSFLNPRTAPLIIEAYRKTVSVQPRLVGFMYRTQYHKSLNRLTTMALHRVFYTQAMTVMRQLRPDMIVCTHPIPNAVISRLRRLGLNVPLCTVITDYDAHATWVSPGVSRYLVSTPEVQAKLEAHGVPSHRIMVTGIPVHPKFWETHDRNTKAAIRRRFGLKESPTVLVMGGGWGLIDPSRSSELLTRWRNDIQFLFCIGDNEKLRQRLLDNPRFRHENIHLIGYTQEIDQLMDVSDLLITKPGGMTCTEAMAKGIPMLFYEPLPGQEEENLHYFTEKGYGEPIESAHTITNWMNKLAYHYEEVASRRREFELNASRYHPKACADAILSMLYEQPPTGSSSA

SEQ ID NO: 9111 - protein, 412 aa, Paenibacillus sp.
MRSINEQKILILTGSLGEGHNQASKAIVESAKKNYPHLRVKVMDYMELTHPRLHVAGQYFFVQWMKHFPSVYGYLFQKTREENTLIQMLKRFSTFSLHKLSTMLETEKPAIVVSTFPPAAAGMSLLKAMGFTDVPTATVMTDHTDHSYWIHSHTDYYMVGSDVVQLALERKGVPSKKISVTGIPVNPLYSQPVDQGRLRDHYGIHASEQVVLIMGGGEGMIDKEVIEWMKSREYPQNVRFMIVCGRNTKLYQSLQEDFSDHSQITVMGYVDRMHELMAMADLMVTKPGGLTISEALTMERPMLLVKPLPGQEQDNADYLVGIGVAQQAMAGELKQQLLKLITTPALLQEMKHKAAINTHKDSALSVLTRLLHIQQSYRLREWSDDITAVPYGVLNREVFENEALHHYYDSYR

SEQ ID NO: 9112 - protein, 499 aa, Caenorhabditis brenneri
MNHSILLFLVFLPLSQSLNILFYVPTLSHSHISFNTKLAEVLSSYGHSVTVLLAQVDDTLLIENVTDYTVLRKKVGVPRGHLRQVLWSNPGPYEDSSPLNPHIFYKLLKVSRTFVTACENMAFDTLFLENLRDQKFDVGLVEQYDACGFGIFKFIGIKSTVWLSATAIYRPQAEAMGVHLPYSYVPELFAHFNDKMSFIQKVINVMIGQATSFVLDVFVQGFQSRIFGFNEDLGEISKQTSSVMINSVPFFDYSMPISHQFSNIGGITVDKKGTKKLDPYWQSVADSAENGFVLVSFGGIARTVDMTSSMQKIFFDSFSRFPQITFIVKYESATNFTMPENVILTPWISQLPLMAHKNYKTIITHGGWSSILETTMYSKPMILMPLFADHAKNSKVAESKGVAVLLDKMRLSQRRVMHAINTILTNPRYTQNCEKFSRMFSDTPIPHEDLIEWRIRQAAKPSRKAFAKHLRPKEPNFHLLKIILFVIPLILVFYSKRVF

SEQ ID NO: 9113 - protein, 329 aa, Medicago truncatula
MENKIISTKSVHCLVLPFPAHGHTNPMLEFSKRLQQREGVKVTLVTTISNYNNIPKLPPNSITVETISDGFDKGGVAEAKDFIIYLNKFWQVGPQSLAHLINNLNARNDHVDCLIYDSFMPWCLDVAKKFGIVGASFLTQNLAMNSIYYHVHLGKLKPPFAEQEISLPALPQLQHRDMPCFYFTYEEDPTFLDLVVAQFSNIHKADWILCNSFFELEKEVAVWTMKTWSNFRTIGPCLPNTFLDKQIKDDEDYGVAQLKSDECLDWLNNKPKRSVVYVSFGSMARVKEEQIKEVAYCLKDCGSYFLWIVRTSEETKLPKDFEKKNQRMA

SEQ ID NO: 9114 - protein, 470 aa, Diploscapter pachys
MFARMNDKVSGNGTSKARRIKNFGWEGSGPWSQRAAYLSSFFEPQPLGLDDISAFYDTTNDLCYLAMSDPSVVEFIKEGNYDLAIATDYEFCPFLLFDIAKVPSVVSYVPTPLFPWNLHMSGVPTTPKVYASVLDAEHNQGFIHTTWHLIKSIYIIYYRIPAKNRNQTGVARQFYGPEVKDGHSLAHRTNILFANSNELLEKPLPLPHKVKYIGGLNLGEPKPLNAEFDRILSNAKKGAIVFSFGTQAPMKFVPFKIRKCFVEAFKRFPDFVFIWKYEKQPDDSELFNNSTNVHPLEWIPQWDLLNDKRVVGFISHSGLNSFNEASHAGMPMLTVPLFVDQLHNAKNGERLGTSILLRKTNITSESVADCLQKLLFDDRYRNRAKTISNMLREKPNKGKETFIEWVEFAAKYGNLHEHLNLPGSLMSPIEYYLIDLALIDISILVISFLVLKRILKSVFASSPREKRKRD

SEQ ID NO: 9115 - protein, 238 aa, Brachypodium distachyon
MDSTGTGSSVAHEGGEGANVFFLPVPGAQGHTNPMLQFGRRLAYQYGFRPTLVVSSYTLSTTPPPDAPFRVAAISDGFDDGGKPSGPDMTEYLRRLEAVGSDTLARLLSDEARAGRPVRVLVYDPHVSWARRVARDAGVPAAAFFSQPCAVNIFYGEVHAGRMAMPVTESDACALVGGGTLGVELRPEDLPPFVALPEWHPVFTKTSIRQFDGLEDADDVLVNSFRDLEPTVICRAAY

SEQ ID NO: 9116 - protein, 224 aa, Citrus unshiu
MENNEKKASASSKLANCLVLSYPAQGHINPLLLFSKRLERKGIKVTIVTTYFISKSLHRDPSSSISIALETISDGYDKGGSAQAESDQAYVDRFWQIGLQTLTELVERMNDVDCIVYDSFLPWALDVAKKFGLTGAAFLTQSCAVATIYHHVNKGLIKLPLIGDEVLLPGLPPLDPQDTPSFINDSASYPAFFDMIVTRQVSNIDKADWILCNTFYELEKEVIK

SEQ ID NO: 9117 - protein, 226 aa, Ricinus communis
MANQTHQLHFLLAPLMSQSHLIPFTDMAKLLAQRGLIVTIIMTPINADRYSKIIELAKNSNLRIQFLTLQFLGKEVGLPEDVKTWIPFLRRSHIPFLSMYRWKRTTGGFLTHCGWNSTLEGVSAGLAMITWPMFAEQFHNAKMINEVLKTGVKINGVEEENHLLVKNEDVKIAIEQLMGDGEEGKDRRRRAKELGKMAKNTVEEGGSSYSNITHLIQYVREHVTPN

SEQ ID NO: 9118 - protein, 538 aa, Anopheles gambiae
MSNCSSQSGRKIPADYSIWLTKTTKPTNSQHPSNPRVIPPTARSRAQYIGLRPLMYEMGRRGHNVTVLSADIEKQPPANVTYVHLENFYSTMYNTSMRQKLNFFEMANESPAKMLKLFDEFGLNLCEAAIKSEGLHFLLGYPTDFKFDLFLSDFMIGPCVPAIIMHRFKGVPYIPTTPYNAPSTAATVLGAYAYSGLVPNHVFDAPESMSFMQRVKNFYYDLYEMILHDTLMHPEADKIVRKLYPDAPPSNSFYKNVRLSLANINPIIQYKEPLMPNMIPVGGLQILPPKGLPEDLRKVVEGAKNGFILFSLGSNARSDLLGPERIRNILTAMERLPQYQFLWKFESDESKLPMAVPKNVFIRAWMPQNDLLAHPNVKLFITHSGLLSTQEAIWHGVPIIGFPVFADQFRNINYCVEAGIGKRLSIQHFQADELVQAVREVLGSDRYSARMKRISRLFRDQKETPLERAVWWCEWVLRNPDADLLQSRAMYMSWFQKYSYDVLTFYLAVILALVALAWKLLSIVKHSFLASSTKSKVE

SEQ ID NO: 9119 - protein, 313 aa, Cephalotus follicularis
MENQSGHVIVVTYPAQGHINPLLQFAKRLVSKGIKATLATTHYTVKTIQATTVGVEPISDGFDESGFTHAPSVQVYLESFKTVGSKTLAELIMKFSDLGSPVSCIVYDALLPWVLDVAKNFGICRAVLLTNSASVCSLYWQIHQGNLSLTVKQETLPLMLPGLPPLGYSDIPSFLAQPENHSAYLAVILEKFGCLSENDWVFCNSFQELESELVMALQGIWPLVMVGPLVPSAYLDQQIEGDTAYGASMWNPSSDNCLRWLNTRPPRTSCDMVQSTRGSSSPSCGLLHYTWWMELDTRGVEPRCPNGGSTAVE

SEQ ID NO: 9120 - protein, 210 aa, Cephalotus follicularis
SSLLFNYLDTVIDWISDMQGIRLRHLPSFVTNTDQDDIIMNFIKGEVGNIPKASKRVKEMAFPWLEMDINLGIPLWNMQLCTYSNKEQPWHLEWLDSKEPNTVGYVNFESLADITSQQLVEFSWGLANGKHTFLWVIRSDLVIGEFTILPPEFLSENKERGLTASWCPQEKVLSHPTIGGFLTHGLNSTMETLSSGAPMICWTFFTDRQT

SEQ ID NO: 9121 - protein, 529 aa, Wasmannia auropunctata
MWSKTCTFVIAFLCVIVQHNVTYAKRILVIANFPSYSHQISYRGLWLELHRQGYEIVVATTDPIKNSSLTNYTEIDLKYFYNGFPEYKTLPYTSLTTAVLEVPLLELERQFIWFIAHILNREVFKNPEMKKLYAASSNEHFDAVIVAQGPTISMNAFAYRFNAPLIGISSLDVYNHMRYTFGSLILPSHISNWQTNVPVENNMSFWRRLVNFYEVWKQMYSWANEHTAIEDALVKKYLGEDLPHIDDITRNMSIYLVNRHPAFLHGRPEQPNVIFYHGFHIAKVPDALPKNVKQFLDDAKEGFIYVSLGTNVKWEDLPNNTFEAFVDAFSASPYKIVWKFNPDLLPRNSKNILALQWCPQQSILAHPNIKLFIYQGGLQSTEEAVYYGVPLIGFPILWDQIYQVRNLVRLGAGVHLQIDNLSKEIVEATIHEVISNTSYKDRVQHLSRLFKDAPYDSLQNAVRWIEYVIRQNGTSFLRNSLCDEPWYQRYDWDIIGFLAIILFITSLISIWALLLILRFHLRIISYSLW

SEQ ID NO: 9122 - protein, 333 aa, Citrus unshiu
  MOD_RES (282)..(290): Any amino acid
MENIEKKAASCKRVHCLVLSYPAQGHINPLLQFAKRLEHKGLKVTLVTTYFISKSLHRDSSSPSTSIALEAISDGYDEGGSAQAEGVEAYLERFWQIGPRSLCELVENMNGSGVPVDCIVYDSFLPWALDVAKKFGLVGAAFLTQSCVVDCIYYHVNKGLLKLPLLDSQLLLPGMPPLEPQDMPSFVYDLGSYPAVSDMVVKYQFDNIDKADWVLCNTFYELEKEVAQWLGKHWSLKTIGPTKPSMYLDKQIEEDKDYGFSIFKPNNESCIKWLNDRANGLXXXXXXXXXRCKEIRQNAGKWSNFAKEAVTKGGSSDKNIDDFVANSISSKSF

SEQ ID NO: 9123 - protein, 205 aa, Unknown
  Description of Unknown: Oryza sativa Japonica Group sequence
MASMNDQHGGATAHVLLVPLPAQGHMNPMLQFGRRLAYHGLRPTLVATRYVLSRSPPPGDPFRVAAFSDGFDAGGMASCPDPVEYCRRLEAVGSETLARVIDAKARAGRAATVLVYDPHMAWVPRVARAAGVPTAAFLSQPCAVDAIYGEVWAGRVPLPMEDGGDLRRRGVLSVDLATADLPPFVAAPELYPKYLDISIVRISPL

SEQ ID NO: 9124 - protein, 262 aa, Brachypodium distachyon
MDSTGKSVMATSEGPSILFLPFPGAQGHANPMLQFGHRLAYQYGFRPTLVVTRYVLSTALPPDAPFRVAAISDGFDAGGIRSCLDMAEYWRRLEAVGSETLSRLISDEAREGRPVRVLVYDPHVAWARRVAREAGVPAAAFFSQPCAVDIFYGELHAGRMAMPVTEADARALLVRGAIGVELALDDVPPFVVVPESQPVFTKASIGQFEGLEDADDVLVNSFRDIEPMRLRLTPSTIWAPTLLWIPSLDAQRPRIQSFRRNR

SEQ ID NO: 9125 - protein, 225 aa, Cephalotus follicularis
SSSQKEIEMDKGHVVVVPYPGQGHINPLLQFAKRLASKGVKATFATTYYTVKSINAPNIGVEPISDGFDEGGFADAKKEDIYIESFKANGSKTLSQLIQKYENTNFPVNCVVYDSFLPWALDVAKQHGIYGAAFFTNTATVCNIFCRIHHGLLTLPAKQEDMPWLIPGLPPLYFRDLPTFIKMPISNPAYLAMKLGQYPNLDKADWSFANTFEELEGEVFFYSLL

SEQ ID NO: 9126 - protein, 374 aa, Unknown
  Description of Unknown: Oryza sativa Japonica Group sequence
AHRHRRRSRWRTSNVGDDNHGGGRVLLLPFPAAQGHTNPMLQFGRRLAYHGLRPTLVTTRYVLSTTPPPGDPFRVAAISDGFDDDAGCMAAPPDYGEYHRSLEAHGARTLAELLVSEARAGRPARVLVYDPHLPWARRVARDDGVGAAAFMPQPCAVDLIYGEVCAGRLALPVTPADVSGLYTRGALGVELGHDDLPPFVATPELTPAFCEQSVAQFAGLEDADDVLVNSFSDLEPKEAAYMEATWRAKTVGPLLPSFYIGDGPLPSNTAYGFNLFTSTVPCMEWLDKQPPRSVVFVSYGTFSSYDAAKLEEVGNGLCNSGKPFLWVVRSNEEHKLSRELREKCGKRGLIVPFCPQLEVLAHKATGMGTNKNSN

SEQ ID NO: 9127 - protein, 518 aa, Haemonchus contortus
MLQFPFWSLAVVAAIIAIANAGKILVYSPSISYSHLISNGRIADTLVRAGHDVVMFIPEYISSTSKFNGTKLAKVIRMNNISTLYEDGLLGGEVGLMKQARLSFTERLEFEYCLTEICRAIMARRNELEPLKNYGFDAAFAEQIDLCGIGVIRYLGIRNLLWISTTPLMDAVSYNLGVPAPPSYVPTIEENDNGDTMNFWQRAYNQYMYFGAIYIHRKGTDMTTEVFRQYDPTFPNVREIAANASLCFVNADEMFDFPRPIIHKTIYIGGLGISEPKPLNEKFSALMKKGKKGVIIVSLGTIAPFHAFPDVTKRAFVSVFKSMPDHHFILKIAKGDSTTQSFMKGVRNCDLIEWLPQSDILAHPRLKLFVMHGGINGMMEALLRAVPVVVIPIFADQFRNGRNAEKRGVGKVILKLELTEQTIKTAIEEVLNNESYKKNAIRLAKLMSEKPFSAEERLVRWTNFAVENGVLDELHVEGSRMNFIVYFNLDVFFVGIIALCLIAYLKINKMSSNSSSGS

SEQ ID NO: 9128 - protein, 512 aa, Plutella xylostella
MNLIKTFGVFASLLTLCVDSLNILCILPYEGKSHFFVFKTFLLELERRGHNLTVISHFPEKSPPANYHDISLAGTSDIFEDAMPLKRNYWTLISTGLFLSWTGTANCDAMLQNKRVQGLVKNKQKFDVALVELFNSDCGLGLAYKLGAPVVSITTHILMPWHYKRFGIPDNPSYVPYHFLEGGSKPTLYQKIERIVFDVYVQTLYYYWTQRNNQNSIARYIGEVPPLEELGRQAKFVLLYHNFVLTGSRLFPPNVIEVGGYHVGKAKPLTGALKDFVANAEHGVVYISFGSVVKSSTLSAEKLEAILAALDEFPQKFVWKWENETQLEGRKNLYVSSWLPQIDILAHPKTVAFFSHSGMLSTTEAIHFGVPMVAMPVLGDQPANAASIEECGLGVQIQYRELTKDSLVAALKKVLDPEYRQQVKALSKTWHDRPMSPMDAAVFWTEFAARHPNSTFRTAAADVWFYEYMYLDVLSVFVVVFSVTVWLVRLACYRARKQDVRKPKAKAKPKRH

SEQ ID NO: 9129 - protein, 504 aa, Caenorhabditis briggsae
MKHTLFEYLILIFLFINTISASLNILFYVPTLSHSHISFNSKLAEVLASHGHRVTVLLAQVDDTLLIDNATDYTVLRKKVGVPRGHMRRVLWSNPGPYEDSSPLNPHIFYKLLKVSRTFVTACENMAFDNLFLESLMEQKFDVGLVEQYDACGFGIFKSIGIESTVWLSATAIYRPQAEAMGVYLPYSYVPELFAHFSDKMSFVQKVINVLIGQATSFVLDIFVQGFQSRIFGFDENLASISKESSAVLINSVPFFDYSMPMSHQCSNIGGITVDKKGVKKLDPYWQSVADSSGFILVSFGGIARTVDMTVSMQKIFFDSFKKFPHITFIVKYESIANVSMPENVILTPWIPQLPLMAHKNYKTIITHGGWSSILETTMHSTPMILMPLFADHAKNSKVAESKGVAVLLDKMRLSQRRVVHAINTILTNPRYTQNCEKFSRMFSDTPISHEKLIAWRIRQAAKPSRKAFAKHLRPKEPDFHMLKIVLIIVPAYLVFCTNKFLYG

SEQ ID NO: 9130 - protein, 379 aa, Brachypodium distachyon
METNSPSSAEEGSGTGGGAHVLLLAFPGAQGHLNPLLQFGRRLAYHGLRPTFVTTRYLLSTVPPPAGPFRVAAISDGFDAGGMAACSTGFGDYGRRLAAAGSETLEALFRSEAEAGRSVRALVYDPHLPWAARVARAAGVRTAAFFSQPCAVDLIYGEVWSGRVGLPIKDGSALRGLLSLELEPEDVPSFVAAPDSYRLFLDAVVGQFEGLEDADDVFVNSFHDLEPKEADYLSSTWRVKTIGPTLPSFYLDDDRLPSNKTYGFDLFDSTAPCMAWLDSHPPCSVVYASYGTVADLDQAQLEEIGNGLCNSGKRFLWVVRSVDEHKLSEELRGKCNEMGLIVSWCPQLEVLSHKATVSSYKTMPIIFLREGFDKVTFTI

SEQ ID NO: 9131 - protein, 346 aa, Citrus unshiu
MEEKIHRAHVLIVPYPSQGHINPTFQFAKRLASRGLKITLALTNFIYKSTKPSSPSGSVQIDTISDGYDDGDLSKAESIHAFFQNMEVPGSKTLAELITKFKSTSNPIDCVIYDAFLYWALDVAKGFGLFAAAFFTQTCAVNFIYYLVHHGLLKLPVPLTPVSIPGLPLLELQDMPSFIGVQGQYSAYFEMVLNQFSNADRADLLLVNTFYELESVVGNFAITKTFSQILSKQVADSMAKSCPVLTIPESKRQSVTTIVNSSHYTNPSASIGSTKSPRTIVVIVAFGKHGLFSQLNKWKNWREGLKKSSFLFSWVIRRHEGRQYKAPKGFVDEMAIKVLIVIGASR

SEQ ID NO: 9132 - protein, 237 aa, Citrus unshiu
MPGKLEELIEEINRQEDEKISCVIADGAMGWAMVAAEEMKIRRAAYLACSSWTTGLLMMKFISLFISRTAIKKHMIQLAPTMATIHSTKLGEWMLCKSKYDLEPGALALIPELLPLGQLLASNRLPFLWVVRPDMTDNSNDDAYQKGFQDGVGTRGQMVGCAPQQKVLSHPSIACFLRHCGWNPTTEGVSDGLPFLCWPYFAEQFLNESYICDIRKVGQRFNKTKMGSSQGKKLRRN

SEQ ID NO: 9133 - protein, 312 aa, Crocus sativus
MIPMVDMARLLADRGVLVSIITTPVNAARIKPVIDRSISAGLPIRFVELDFPCAKAGLPDGCENFDLVPSIDLYKPFVEAFEFLREPLELYLREPDVPVASCLITDSCHWWTAAVARAFGIPRFVFYGPSCFFNLCVHNIRLHDAYGSVVDDFEPVVIPGLPLRVEIAKAQAPGGWFCTPGWEDIHGKVVEAAGTADGVVINTFRDLEPEFLGCYEKAVGKSVWPIGPLSLYNKDFASKASRGNKASVDEGRLSSWLDSMEPGSVVYVSFGSLARNGPSQVVEIGRGLEGSGRPFVWAMKEAERCPEVEEWM

SEQ ID NO: 9134 - protein, 270 aa, Zea mays
MYTAASRGQQSPRISPGCGVVHDKGLRHYGLVTDHAPQQAVEGGGGTEESLDEPVPDLEPLQARDLIRVDGSDTDALCGFVGHVADAVRASASGVVIYTFERMEASELAKIQRELSRPALARAVPSGVRGGASALAVPGTDGAEPARARPRLLAWLDDHPPRSVLYVSLGSVACVDRGAFVEMAWGLARSRVSFLWVGRPGLVGGVARAGPTQTGRAGGRSSSRACCGGLGPNAGRAGDRSSSRADGGGVGPNVARAGGARAGPAAAVRG

SEQ ID NO: 9135 - protein, 243 aa, Punica granatum
MEKSPGKLSRIVLVPCPAQGHLSPILQLGAVLHSQYGLSITVVHTNFNFPKNQPPPFRFISMPDHLSDEDISSNDFINVMSKLNINCKVPFRDVLGNLVQQAGGEEAGVACVIYDGVMHFPEEVARELGIQSMVFRTLCAGNIRIYKEYPRLVKEGYIPVHESKSLDDVPGLHPLRLKDLPVYKLKGYEGLLRLLEKACETGSSSAIIINTTEALDREALMELQKQHHIPVLAVGPLHKIAPP

SEQ ID NO: 9136 - protein, 540 aa, Wasmannia auropunctata
MSSCFILLFSLVCCISISLVAASKPLSILLIEALPTSSHHIWTVHLIKGLLRKGHHVHAVSIHETKVEGKLAQNLTYSVFDGLIDEFEKSEEFNPTVWAEYSAFYMSYFMFDLGIQTCDIVIETKAAKELLETIKTVEFDVIVQDISLLECLFGLWEVAKGKPPAVGYVPFGPAPWIKDYVGGSNYPTVRSFPYVAIAKPVGLWQRTWNVLYYVADDLLRHYYYLPIIQRQTEKYMGHAIRPIHDIEKDSINIVLINSHSAFDSGIPLPPNALEIAGLNAQTVQPIAGEKVITYPENMRIFLDEAKNGVIVISLGTNVKWEFIGVDKVEAVILALSKLKQRVLWKLDIEMSSKIPDNLMIVKWMPQNEVLSHKNVRAVWTHGGLLSTQEAIWKGVPMIVMPFFMDQKSNAEMLVAKGVGTYLDVRNFTVQNVLYAIEEVLYNESYTRNMKKLSSEFRDRPLPPLDLAIWSIEYAVRHPNGSLATPLRSQSWIEQNLIDVYTFLFFILTILLLSTYFTIKIIINLCCNYMYTSKLSKKKQA

SEQ ID NO: 9137 - protein, 206 aa, Helianthus annuus
METLGSVSTIRSRRIILFPLPFQGHINPMLQLANILHTRGFKITIIHAEYNSPNPSNYPHFTFKPIKDHLSKVAHEYPTNRDGTYFVRYLNKSCVDPFTDCLAGLLAEPGEERVACVITDACFYFTQAVADDLKLPRIVLRTSGLGCTLACDALPFCSKKACFYLTKQDSDYEASVPEFPLLKFKDITNITINPQDLKNQCRNIHY

SEQ ID NO: 9138 - protein, 296 aa, Panicum miliaceum
MAGGVGGREPRRRALVFPLPFQGHIDPMMHLAGALHARGLAVTVLHTRFNALRPARHPEFRFVEVPDGVPADVAREGKIIDVILAMNAAMEASPAAVRAALASAMNDEAEGEGRPPRRAACLFVDGNLLAVQRVAEALGLPTLVLRTGSAACLRCFLAFPMLHEKGYLPPQESNLYTPVPELPPLRVKDLFLSPVSSHEKVREVLARITETVRNSSGIVINTSEALEAAEMERLRAELAGAHLPLLLAAGPLHKLSSRSAGSSLLDQDRSCIAWLDARPPGSVLYSPPSNDKQWNP

SEQ ID NO: 9139 - protein, 300 aa, Hordeum vulgare
MRKEEFGEQELVVAAVLADLLSPSGRDLAGLCGGLLRRRPYPHAPAAGSSALSVRQAGRGAELAGLLHARGFAVTVFHARFNAPDPSRHPAYGFVPVPDGLPAGTPETVAATMEHILAVNTSCEAPFRERLAALLDAPGARDEVACLVADAHLLALVRVARRLGVPTLVLRTGSAACFRNFLANPVLCEKGYLPVGAESKLDAPVRELPLYRVRDLMGANSRSRHEHELMCELLSRAVEAVRSSAGFVLNRFDALEADDLAATRRDLAGVPVFDVGPLHKLSPASSCSLLQQDRSQQGIE

SEQ ID NO: 9140 - protein, 269 aa, Atta colombica
MATLVTYLFTHAHSILANINIKIAKRDCATVSFEHGIPLSPNILEIAGLNVQAIKPIDGEIVVTYPEDIRAFLDGAKNGVIIVSLGTNVRWKFIGLDKIKIVSLALSKLEQRILWKLDIEVPFEIPDNLMIVKWMPQSEVLSHKNVRAIWTHSGLLSTQEAIWKVPMIVMPFYIDQNFNAQKLVAKGVGIYLDVKTLSTQTVLHVVEEILYDERRDAAKHIGPPYQAVLGNEALFPSPCALPLPPFECGPSYEFAWRGLTAYWLRHFLF

SEQ ID NO: 9141 - protein, 371 aa, Oryza sativa
MATQEREPERQPHAGRRVALFPLPFQGHLSPMLQLADLLRARGLAVTVLHTRSNAPDPARHRHGPDLAFLPIHEAALPEEATSPGADIVAQLLALNAACEAPFRDALASLLPGVACAVVDGQWYAALGAAARLGVPALALRTDSAATFRSMLAFPRLRDAGFIPIQGERLDEAVPELEPLRVRDLIRVDGCETEALCGFHRPRRRRDAGFGVWGRRQHVRRHRGVGTGQDRGRAVQANLRRRAAAQAHHGEDGGGAVPPFRAPVRSGPRLPRVAGRAPAALRAVREPGERRLHRPRHVRRNGVGSRRQRRAVPLGQPARLRPRLYASATLRGRREQGQDRAMGAAEGRPGAPGHRRVLDALRVELDAGERL

SEQ ID NO: 9142 - protein, 280 aa, Aegilops tauschii
MTTQEKAPHAVRRRVVLFPLPFQGHLSPMLQLAELLRARGLAVTVLHTDFNAPDPPHHPELAFVSIHEALPHVATSPDADIVAQLLALNNGCEAPFREALASLLLLLLREDVACVVVDGQWYAALGAAGVLGVPVLALRTDSAATFGSLLAFPRLRDAGYVPIKEERRDELVPELELLRVRDLIRIDGSDVDALCGFIARVADAVWASTSGVVLNSFDAIETPELARIEKELSCPAFAVGPLHRMCPGPAPAEHGLHAPDRGVTTQRRKRGGDRDQIEGR

SEQ ID NO: 9143 - protein, 263 aa, Citrus unshiu
MERQEQQKASRLVFVLYPSQGHINPMLQLATILHSKGFSITIIHPKFNSPNSSNYPEFTFIPISDNLPESQDSFGDIFGIVSALNKNCEGPLTECIQQMLKAEDPQDRLSCIVYDSVMHFSQSVADHLKLPGISVRTGPAATMFAFAVCPRLDEQGYISFLESMSLDGKSDLLSLLLKELAFSMKKFTAHGLLELRAAVTDSVQRCSALILNTVDFIEQEALTKVQELFSASAFTIGVMSSRQINLDHDGYELDQITYPTQVV

SEQ ID NO: 9144 - protein, 528 aa, Daphnia pulex
MIKCSVFLVLVVNCFVFCHASKILVLSPVASKSHKISMMPIVRALAQRNHHVTIVTSHSQEEYLENVHDIVVPNPYMNDGKFDWFAMNSINPFVLQFQIFYNFATISKFNYEAVMNNPEFLLVLKRREIDLVILDDSFNDFCLKIIEDLKVPFVYFSSSTGYPWVFNSMGASQELSSVPSRFTGYDSTMNFKQRIFNTLAGLGAQILRSFIVIPAIDAYTKKDFPSARSISDIEKDASLYFLSSQWATTWPRSVPPTVIQLGPLHIRPPQTLPQAMDRFIREFEKDGFILFTLGSIPSSKFMPKKYVQTFVKVFSRIPQRVIWKWDDSSEIPENLSANVLLVDWLPQQDLLGHSAIRLFITHGGFLGMQEALYHSVPLLALPFGTDQYLNSAKVRKEGCGLHLDWDNLDEATLFTSITSIINNSSFKDNTRRLSLLMHEEFLKGQDTAVNWIEHVIRFNGTKHLKPTSQNIPFYQLYLLDVGLFLVVISFIIVFVTANMVRFIIWCLLASFYKFKTTPSYKSNLKKIT

SEQ ID NO: 9145 - protein, 204 aa, Punica granatum
MQASVLGSPTGVGSSPVPGPHKPDAPTCSGFSTHMASPSSSLTLRSTRDPSITVQTCSASNIVTYLAMPRLFQLGLIPPQGWGWVPPLQATCQRRTLVAKHGLTNKPLTRSSTSVQEAVLMNEKEVSERAWGLANSKQPFLGAVQPGSVQGLDRLEWLLEGFWQGVGERGHIVKWAPQKAVLADKEVGGFLSHSGVELDPGEHC

SEQ ID NO: 9146 - protein, 968 aa, Trachymyrmex septentrionalis
MNLIKGLLRKGHHVHAISTYETNIKDKLAQNLTYDVFDGLMKVIEESEEDFDPVKWEQYNVFYMMYSAYHWGIYACDSVIKTEAAKKLLEMIKTVEFDIILQDVTFNECLYGLWEIAKGKPSIVGYIPYSAAPWLKDIIRGPSYPTLRSYGYLPIAKPIGLWQKTWNTVCFTVDDFTRHYYYLPIMQRLAEKYVGHSIRSLHEIEKNSINIILLNSHPAFEHGIPLPPNTLEIAGLNAQAIKPIDGEIVVTYPEDMRAFLDGAKDGVIIISLGTNVKWKFIGLDKVKTVLLVLSKLKQRVLWKLDIEMPFEIPDNLMIVKWMPQREVLSHKNVRAIWTHGGLLSTQEAIWIGVPMIVTPFYVDQKFNAQKVVAKDVGVYLDINTLSTRTVLHAVEEILYNKRYTRNMKQLSSEYRDRPIPPLDLAIWGIEYAFRHPNGTLITSLSLVTTSKTLSILLLEPIPSTSHHIWAENLIKGLLREGHHVHTISIHETKIEGKLAQNLTYAVFDDVMKTYEESEDYNPSEWEQYSVFYTGYFTYQWGINACEAITKTKAAKELLEMIKNVEFDVIVQDITLTQCFYGLWEIAKGKPPIVGYIPFGPAPWLKDFIGGSSYPTVRPYTHAAIAKPVGLWQRTWNTLYYFMDDLIRYYYFLPIVQRLAEKYVGHAIRPLYEIEKDSINIVLINSHPAFDSGIPLPPNTLEIAGLNAQSVKPIADEVVVTYPEDVRVFLDGATNGALIISLGTNVKWKSIGLDKIKTVILALSKLKQRILWKLDIDVPFEIPDNLMIVKWIMQKEVLSHKNVRAIWTHGGLLSTQEAIWKGIPVIVMPFFMDQKSNAQILVAKGVGIYLDIKTLSKQTILHAVEEIFYNESYTKNMKQLSSEFRDRQISPLDLAIWSIEYTVRHPNGILVTPLKFQSRIQQNLIDVYIFLFFNIIIILLTIFFVIKILIYFYYNYIYTASKFHKNKQS

SEQ ID NO: 9147 - protein, 479 aa, Atta colombica
MSSCFILLLLAYFIVIGLVTTSKPLSILLIDPVPSLSYHVWTTNLMKGLLRKGHHVHVVSTHEIKIKDKLAQNLTYDGSNVFDSLMKVMEESEDFNPVEWEQYSALYMMYSAYQWGIHACDAVVKTKAAKKLLEIIAKSKPPIVGYIPFSPAPWLKDLIGGPSYPTVRPYAYLPIAKPIDLWQRTWNTKKTVLYYSIVILHGIPLSPNILEIAGLNVQAIKPIDGEIVITYPEDIRAFLDGAKNGVIIISLGTNVRWKFIGLDKIKIVLLALSKLEQRVLWKLDIEVPFEIPDNLMIVKWMPQSEVLSHKNVRAIWTHGGLLSTQEAIWKGVPMIVMPFYVDQKFNAQKLVAKGVGIFLDIKTLSTQTVLHAVEEILYDERYTRNMKKLFSEFRDRPIPPLDLVIWGIEYAVRHPNGTLATPLRYQSWMEQNLIDVYAFLLLNFTIILLSIFLIIKVFIKFYYRIYTTFNNKLHKRKQA

SEQ ID NO: 9148 - protein, 217 aa, Helianthus annuus
MLFTFCFNYTTLEKSLKLFIAHVIYFLFQLAPKNLNFPIMKNHEGTGTIFQSTRSTATRGRVILFPLPVQGHLSPMFQLANILRAQGFKIIIIHTEYNSPSHSNYPHFTFKTIADGGFSEIRNNMKKSDPAFSISYFNEHCADSFTDCLAGLLAEPDEPPVACLITDAEYYFAQEVADSLKVPRLVSWACTIVSLLVYRDLSFFYEKGYFNLTKNGV

SEQ ID NO: 9149 - protein, 263 aa, Helianthus annuus
MAKLTKIAMNNKALVLFPLPFQGHINPMLQLANILYTKGFKIIIIHTNFNSPNPSNYPQFTFKSISDGLSTSKDKSLNLDTTNHAINFMNKSCIDPFAVCLAKLLEVEPVACLISDALWHFTQSITDRLKLKRIVLRTSSMSCIPLYAALVLGEKSYYKTTIKEELALMTKMDIEKIYKGGLEKAKAELICNMINETKAASGIIFNTFKELEEPAFLAISQVFQIPSFAIGPFHTYFPASHSSLIEQDRSSISCMNMIRWFCW

SEQ ID NO: 9150 - protein, 463 aa, Unknown
  Description of Unknown: Phyllobacterium phragmitis sequence
MRIIMAATPALGHVIPMLGIARILLSEGHEVVASTASAYQDRVKSVGAEFWPLPESADHDAQAKLPELKTLPPGFEWLRAAMCGLINEIPAQYMGLQQMLQEAPADIVIADDQFFGVLPMLLGARSARPPVVLFGTTILHWHREDGAPNFLGLHPAISQAQHEEYAAITREYDNIVRYPVTRYLDRCLEGVGAGPLSKPLLESVVELTDAYMQLSVPSFEFTHAVPPSVQFVGALPIIPNQAPLPPWADDLDGRRKVILVTQGTLANHDFNLLITPTLAALADEPDLLVVVTTGGRPIEVIPRPIPANARLASYLPFEWILSKADVFVTNGGYGSVNQAMSFGIPLVAAGLTEDKADVNARVAWSGVGVNLATNTPTPVALRNAIRAVLDDAQSYRQHASLIAKEFAAIDTRAEVLRVVGQVAQRLEGVHTHQSRELSLSSWPYFGVNDSIYLDNTQEYKIRS

SEQ ID NO: 9151 - protein, 428 aa, Pseudomonas stutzeri
MTHFAAIAPPFLSHLRAFEAIAWQLQQHGHRVTFIQQADVGALLDLPAAGFAAIGTDTHPPGSLGAVVRRAASPGPFGVRRVIADMAASTELFCREAPAVLRALEVEAVLADQMEPAGALLAEHLGLPFVSIACALPFNREPLVPLPVMPWRYRATDWGEQLNRHSSGVYDRLMRPHGEVIERYCRAFGLARRTSLSDCLSPLLQVSQTVNGFDFPRQALPPHFHALGPLRQPLPMAAGLEWPLDRARPFVFASLGTLQGHRYGLLRNIARACRRLDVQLLIAHCGGLDAAAAARLRQEGACWVTDFAPQRAVLAQASAVVTHAGLNTVLDALEAGVPMLALPIAFDQPGVAARIEHAGVGLRLLPALASPARIAHALRRLLDEASFRQRAAALGEEVRQAGGAARAAELIESALGCVRPRSEVADDA

SEQ ID NO: 9152 - protein, 421 aa, Consotaella salsifontis
MAHFALICPPFFSHIRVFEALAGELARRGHRLTFVLNAGAESAVRSNVASVRIVAPGNASQPIEVVIRRAARPRGPLGILRTVSDTARLTDALCRSAPAILREIGADAVIGDQMEPAAGLIAGHLGLPLASLACALPINPEPQIPLPFLPWSYDPSPKGVKRNQGGEAVARLLLTRQRRTVAAWAERFGLSPRESLADCLSPLAQITQAVESFDFLRKDKDALRYVGPIRESGGAAAALPFDIDPHRPFVFASLGTLQGHRLGLFKAVARACRELDAQLLVAHCGGLDARQAASVGATWITDFAPQRAVLARADLCVTHGGLNTVLDALEAGVPLLAIPIAFDQPGVASRIAYHGLGSVVSPRLLTARKARHAMKRLLDDDGFRERARAIGRDIAASGGLRLAADIVEEAVLASAPRRGAA

SEQ ID NO: 9153 - protein, 370 aa, Ancylostoma ceylanicum
MLEQYDSCGFGIFRAVGIHNIVWLSATGTYAEQPQTIGVNYPLSYVPNLFAPLGDEMNFLERAQNVLISAVTSLVYSSTRAQQSKIFWRTGDLAFGEDLLSTARSSDSIVANTLPSLDFAMPTSNKMAYIGGFTVQKQPGVLDMFWKEIADSSTRGFILVTFGSIARTMDMPLKMQNNFFTAFSRFPEITFIVKYETANSTVTIPPNVQLTQWIPQAKLMAHPNYLAIITHGGWSSILESINVGKPLVLMPLFAGWLLPSDHGKNSKAVEAKGAAVILDKMNPKTADIMKAITSVTTNQRYRENCAKLSRMMQDPSPIDHAALLDYQVRRAAKLTRKSFQLSPKECIHSPISSYLEVFIGISIALVTIAS

SEQ ID NO: 9154 - protein, 473 aa, Eumeta japonica
MQIRMIVAGAVLAAFCAAGPAGGARVLALLPHPGRSHFMVFEPLLEELAARGHRVTVVSFFPREPGRALPGYHDISLVGIIDIFQEVIPLSMFEPSPFGLDRFGHLFMLKMLTDWAVKICEKLQHWPPLQPLYENPRGSYDVVIVEMFNSACPLGLAHATGAPIIGITSHQDLTWWTGTFGQFDNPSYVPNVLLPFDQNMTLLERVANTATMAIQKVWFDWACWRETGVVRERLGTATPSLCELRRSLSLELLNTHHSLNGRYERPPSTIEVGGLHLRSTANASLSQDLEAIVSRAEAGVIVFSLGSMVKATTLPKEKREIFLRVFARTPQTVLWKYEDPSSLKDLPPNVHAISWLPQRALLNISDFEIIGSQCNFLPLKYLVFQFSFDFKKRVKTTWCLSQGYTVGEEVDTFFKRKKLRVPWRGCAAALTWCQKRCRIRDFGRLSHRADNTVGAQTVIHHSESTLFEPLTPE

SEQ ID NO: 9155 - protein, 436 aa, Nakamurella multipartita
MTLLVISPDYASHLLPLATLATAWRDAGERVVVASGPATAAITADFGFARTDLRLGRGSNPGVIRAQEQVAGEDDALRGFFAATERGMVPTLQYQADARRADLLWDPVATARRVLAVVDQVRPDHVLVDHLAFSARLALLAGGVPHADVVLGHPTALPVGDEVYGYPPAWPAVFTPDPDDLATLHQRCREVRDGFTAEWNAALAELAPQAPASVDAFTEHAGQVLLNYPAALHDPARTALLPSHAFLGSAVRAQPTPPDIADWLAADPSRPLVYVSFGSFLSVRADVLARVARALAALPVRVALAVGSADRAVLGELPPHWLVREFLPQVALLEHAAVTVTHGGNNSVTEALMAGVPMLVLPFSTDQFAGAAAIVDAGVGIALDPNAASPAELRAALAELLDGDQARVAADLGAGLRERPGRQIAWQALAPAATGN

SEQ ID NO: 9156 - protein, 265 aa, Arthrobacter sp.
MHVAFICLPAAGHVNPTLPVVAELVRRGHRVTYATSAKYAKAVEAAGAVFFPSGEDLAAFLPPRDRSASGSPTPADGGAAPASGGPSPMPGMFAGMPSGMMSGLLDRILKGAREEFPALLARLAEDPPDGVAYDAMTLSGKMAAAKLALPDIALLPSYATNEHFSMRDLMPGPPPPGMVEAWKQVGQRIHDFAAEQGVGHLQFMGGPPASLNISFIPREFQPRERLSTAGSTSWAHALACVATRKPGGPGPRTGRCCSSRWGPPR

SEQ ID NO: 9157 - protein, 528 aa, Cyprinodon variegatus
MKLHLTVLVLLLLGASKFSNGGKILVWYTEASHWINMKPLLETLVDRGHQVTVLIPSASMFMNSSEPSRFQYEPFNITLSVNEMERLFQDFLHFSVYEMQFMSYFDIYVKFIGLLKENMRAFLSMLNGVVKSETIMKKLKDGKHDLLLADPIYPGSELTADMLGIPLVYSLRFSLAHNWERMCGQLPAPPSFVPGAMSKLTDKMDFSERLWNVLFYALQDKVMEQFLWNELDIYYSEIRGKPTSACELMGNADIWLMRTYWDFEFPRPFLPNFKFVGGIHCGPAKPLPEEMETFVQSSGDAGIVVFSLGSMVKNVSIEKANMIASALAQIPQKVLWRYSGERPQTLGSNTKVYDWIPQNDLLGHPKARAFITHGGTNGIYEAIYHGVPMVGIPMFGDQADNMVHMEAKGAAVAVNFNSLTTESLRDAVNTVINEKVYKENAMRLSRIQHNRPMSARDEAVFWIEFTMRNKGAKHLRVQAHQLSWYQYHSLDVLALVTVIALLVTFVFFKICSFVCQKTCGKKIKTKAD

SEQ ID NO: 9158 - protein, 428 aa, Pseudomonas xanthomarina
MTHFAAIAPPFLSHLRAFEAVAWALTQRGHRVTFVQQADVAELLTLPSAGFAAIGAESHPPGSLAAVVRRAAQPGPFGIRRVIADMAASTALFCRESPDVLRSLKVDAVLADQMEPAGALVAEHLGLPFVSIACALPFNREPLVPLPVMPWRYRATDWGEQLNLHSSRVYDRLMRPHAEVIQHYCQAFGLAPRSTLSECLSPLLQISQTVPGFDFPRHQLPANFHAVGPLRRPLENEAELNLPIDPTRPFVFASLGTLQGHRYSLLRNIARACKPLGVQLLIAHCGGLNAAQAARLQDEGAYWVTDFAPQRVALARAAAVITHAGLNTVLDALEAGVPMLALPIAFDQPGVAARIEHAGVGLRLQPQLASPARIGHALQRLLNEGEFRQRAAQLGAEVREAGGAVRAAELIEAALGTDGQRLEVASGA

SEQ ID NO: 9159 - protein, 410 aa, Bacteroides fragilis
MKHLYIIDQCSSASLYGIGTYIQQIINIWRMDVCSALTIVKLESGTNVIEEGWSDGVRYLWFPSETEEEEMRHESYCLDLAESLRFCMNEEEDNIFLVNYLSHSELILNLKKIISSCRIIIVIHYVGWYTMKRRNGSYLECLLGKVSTDRDATEKIVYKEFVANKDFFLKADRVVCLSEHTYNLLRNVYGIVEQKIRLLYNGLVDEARILDIEQRKIQKGNLSFKVEDQIILYVGRLNQIKGVYYLINAFRKLLDCLPNVHLLVVGDGDYSAYLSECEGIWSHVTFTGRIRKEKLYQLYQISDIGVLPSLQEQCSYVAIEMMMHGIPLIGTASTGLEDMIQEGLNGYAISIEDVDAYPEVFIEKLKSSMVRILSLSIDEKNAMRQQSRNVYLKHYTLNVMQEGMKELEWI

SEQ ID NO: 9160 - protein, 529 aa, Sorangium cellulosum
MTMDAILPLSDHRSDRAPHEAIAPARHTPSTGPARGGLSSVRVQAAIPENPFAALSGANGRPLKVAILSDFTRIPYANGAVFQTRALYRALNTCGHQATLIGPRDPDASADEIPPGTVALPSLPLRTYPGVHLPIPVGSSVLDPMRWDFDICFAQTTTLLVEFGIWLRKMRGIPLLCVNTTHLAAAYDVLLPERVSRIGAVHTVLHKTLRAPMERLFVDLYNQGDGLVVLSEGLRDYWRERGVTVPIHVIPRMVPEDVFERPLGPDPYVQLLEERGLDPRGPRLVCAGRHTREKSQHRLIRIFAEHIAPHEPQATLTLVGDGPDSAAYAALARELGVARRVIFTGEVPYSQISDYYRHANLFLHASLSETFGNVLSEALWCGSPTVAFADGMGVSSQIQSGHNGLLIDPGRGPIAEESANAAFGKAVLALTRDPLAAARLGSAAAQRARERSSPLVVQRMLANAFAHAREHARQSNLRPLVDGPKALQWLETFRHFRTWMGFTGGLFAFGHLRPAAAPRPKGIQPSFCA

SEQ ID NO: 9161 - protein, 365 aa, Unknown
  Description of Unknown: Halobacteriales archaeon SW_5_68_122 sequence
MQTVSVFTDTYLPTVNGVTYTVRTWRDRWERRDGLMPVVYPDDDEYDPGTREFPVSSVAFPFYPGFRFGRPGIPDGVRELSPDVIHAHTPFTLGLSARRLAREAGLPLVASYHTPAREYAGYISNSFAGAISRVADRYERWFFGEADAVVVPSETAADRVATDGTPTYVISNGVDTERFAPADPEAVAAFRDRHGLPAGPLVGYTGRHGYEKCLEDLLAASVGLNATVVLAGDGPARPELRRRAAARDDIVFLGFLDRKELASFYSALDVFAFPSPIETQGLVALEAIACGTPVVGVDSGALSESVVNGETGYHFPRDDVGAFRAAMQRALAERAALSERCLAIRPELSVERSIERLAAVYDDLC

SEQ ID NO: 9162 - protein, 529 aa, Sorangium cellulosum
MSIDVIQPIGEHRGERAQHAASAPARPVPSTGSARGGSSSVKAPAAIPENPFAALSGANGRPLKVAILSDFTRIPYANGAVFQTRALYRALNTCGHQATLIGPRDPDATADEMPPGTIALPSLPLRTYPGVHLPIPMESSVFDPMRWDFDICFAQTTTLLVEFGIWLRKMRGIPLLCVNTTHLAAAYDVLLPERVSRIGAVHTVLHKTLRAPMERLFVDLYNQGDGLVVLSEGLRDYWRERGVTVPIHVIPRMVPEDIFERPLGPDPYAPLLEKRGLDPRGPRLVCAGRHTREKSQHRLIRIFAEHIAPREPNATLTLVGDGPDSAAYAALARELGVERRVILTGEVPYNRMGDYYRHANVFLHASLSETFGNVLSEALWCGSPTVAFADGMGVSSQIQSGHNGLLLDPGRGVAAEERANAAFADAVIGLVRDPAAAARLGSGAAQRARERSSPIVVQRMLASAFVNAREHAAQSGIRPLVEGPKALQWLETFRHFRTWVGFTGGLFAFGHLRPAAAPRPKGIQPSFCT

SEQ ID NO: 9163 - protein, 353 aa, Unknown
  Description of Unknown: uncultured bacterium sequence
MLENTKKKRLNIAIITNNYTPYSGGVVSSIDSFVNELHKQEHKAFIITLDFLGITRNDPYHVIRIPSLFRFMYKKNHMALAIKKEKKLQEIIDILKPDIIHVQHPFYLCQPAAKIAKKLNIPVIFTYHTIYEKYLHYLPLPQFITRPIVKKIVLSFCRNVDYIVSPSSYIKNYLESNNIETKIEKIPSGILPIFIKDQVYAIERTETTEKNGKNIFNLIFVSRFVKEKNIEFLLCMFAKLVQKNPDKNFKLTLAGYGSEYEKIKKFAHKKLKLTNYIQFIYRPRKEDIADLYMQSDAFIFSSDSDTQGLVLAEAMGCGCPVIALDGPGQRDIIKDCINGFLCNFESDMIEKIL

SEQ ID NO: 9164 - protein, 397 aa, Clostridium tunisiense
MKILLTTDTYYPMINGVVISTSNLYKELKEKGHQVRILTLSHTGEERTEGDIYYLKSLKINVYPDARIKVPFYNKLIKEIIEWHPDIVHSQTEFSTMIVAKHIAKKLDIPQVHTYHTMYEDYLGYILGGKVIRKGGAAKVTKFILDSVDEVIAPTDKTKTALREYGLHCPINIIPTGIDLGRFQKNVTQDEKEQLLLKLGLSDQDKIMTYVGRIAEEKNIDEIIGHFPEILEKVPKAKLLIVGAGPHLEVLKELAKEKALEESIIFTGMVEPTEVYKYYKIADVFVTASTSETQGLTYIEALSCGCPIVCRYDKAIDGVILQGTNGFSYKNSWEFILYASEVLANDELKEELSRKAMSKANEYSSKTFAGRVEDLYVKAVSYGETYNSGVRASGLNY

SEQ ID NO: 9165 - protein, 403 aa, Unknown
  Description of Unknown: archaeon GW2011_AR3 sequence
MRIAIFTDTFYPNVDGVSIAIANCVEILARKGHEILIVAPDYGLSKEMNLAKNVTVQRIFSVSMPTYRSFRFVFPLYGKCLQSVRSFKPDIIHIETYSTLGYLGARIAKKLGLPLVGTYHTLASEFVKYLSPLNLFGINGLIENIIPHKMSQTLPPKKDGFMKRTIWRTTIRLYNKCNLVVTPSPSIKGELESRGLKKPILPISNGIKVEIFANKRKFPKKPRKILYVGRVSYEKRVDLVIFAFSHVIKSVPDAHLTIIGQGPALGSIKILSEKLGLSKNVSFIAFMKQEMLGGYYRQSDIFMTASPMETQGLVLIEAMSCGLPCIGVDRFAVPDVIHHGINGYVARQNYAQEMAQYAVRLLCSSGLYAKASKAARQEALKHNLKKCVEKLEKVYLGLAPIKH

SEQ ID NO: 9166 - protein, 517 aa, Anopheles sinensis
MAILQTVLLVALAVSPLAQAYKVLGLFPHPGQSHFHFFQPILKGLAEAGHEVTVVSHFPEKNPPPNYSDIPLEGMMSLSDSVSFELFEYRPGFGHFMEFFMLYNWGKEACANALNSSAIQTVLDSKVQYDLILVEQFNSDCMLGIAHQLKAPFIGLSSCPLMPWHYERVGNPTLPAYVPALFMGYTERMDFSQRLANWITVQSFKALYSWFNDAAANKLLRARFGEGAIPDVRELQQRTAMMFVNQHYSLSGAKPLSPAVLEVGGIHIQNFQPLDGELQQLLDSADHGVIYISWGSMIRAETLPAEKRDAILKALGRLKQRVIWKWENETLPNQPANVYIRKWLPQREILCHPKVRVFMSHGGLLGSSEAAYCGVPVVATPMYGDQYNNAAALTNRGMGVVLHYEDITTDTVQEALRKALEPVAMESAKRVSFSYRNRPISALESAVWWCEHVAATGGLPLAQSYSSELPWYSYHQFDVYIVTFTFLALYHACWIWLFKRVCCRGVSGFKDEKVKTN

SEQ ID NO: 9167 - protein, 469 aa, Ooceraea biroi
MRALASRGHNVTVVSTIPLKNPPPNYENVDLSFSYRKKDCTGLRHMGAYTLLHKNMEEANELCREQLFSSAIAKLIASNKTFDAVIIEQLWYQCYYALVKHYNFPVLMGFLSVGNLPYVMDSVGNPDDPNMSPDMAYPFTNRMTIDERIWNTLYTTWTRLYYRYWHLSRAQRIANEWALGTSVYDIDKNFSLVILGNNHVFGYPKPLLPNVIEVHSLQISEKFEPLPEDIRAFLDNAQDGAIYFSLGSNLQTHQLPAGPLTALCNALGSLKQRVLWKHDGNMAIHPANIKFVKWAPQQAVLAHPRVMGYVMQGGLQSLQEAVHHSVPVVAIPFFGDQLFNARKILDAGIGLTLDIDSMTEDSVVQTLVEIVENKTYLNNIKTMSAIIRDELVKPMERAVWSVEHVLKFPNSRHLRYHGRDMSWIDYYATFLCLTVCLIVLSYFICILCIKGAGVFVRSKWINDLKQKFD

SEQ ID NO: 9168 - protein, 522 aa, Spodoptera exigua
  MOD_RES (64)..(64): Any amino acid
  MOD_RES (69)..(69): Any amino acid
  MOD_RES (79)..(79): Any amino acid
MADLRSVLFGILLMFCSCEAYKILAIFPVPSTSHGILGDNMIKHLLNAGHEVTYITPFINKKKXDHPNXKIVDVSANAXISCDSLTDIKLIMDGVLDYKDPVLMSQLTIMMASHTLGNPNVQKFLKDPNQQFDVIIGEYMFSDLYSSFQAVFQCPFIWFSTIQPHWAILNMVHGPLNPSYNSDYIIGNVAPFTFKERVYELWVQLKGLYYHKYVNLGAEEKVYLEHIAPIVKAQGKPVPNYEELKYNASLVLGNSQVVFGNAVPLPPNYKHIGGYHIDEDVKTLPEDLQKLMDNAKNGIIYFSLGSNIRSKDLPDSMKDGLLEMFGKLKQTVIWKFEKSLDNTPKNVHIVQWAPQQSMLAHPNLVLFITHGGLLSVTEAVYFGKPLVAIPVFADQFLNANSFQKMGAAVKVDLTYNLHKGLEVALNKVLPELPKYTARMKEISVAYHDRPMKPKEALNFWVEHVVRTRGATHLRSVALQVPLYQQAYLDLLAVLLAAAVAILLVVRRILSLFTSDGRKLKKN

SEQ ID NO: 9169 - protein, 463 aa, Papilio machaon
MLHFSLCLLLLVGSILNIESSRILAVYPCPSISHQIVFRPLTLELLKLGHELTVVTTDPMFSKENAPANLTEINVHDTTYGVIRKIISNAVTGSKTDLLNQALVVKELIYDATEAILQTNDVQNMLKNEKRYDLIFIEALFTPMLGLSHKFKAPTILVSSFGPFIGSYEIIGAPTKALLYHNMYSQRLHNLTLIEKISELYNYVRIQYIFNYSDEKLNELLKRLFGSDTPTLSKLKDYVDMLFVNTHHVWEGNYPVPPTVIHMGGLHQKPQKPLPEDLQQYLDSSENGVIYFSFGTNVNISNLPQEKIMIFKKVLSELPYNVLWKIEDDNLPGKSKNIKTFKWLPQADLLSIEDSLKNAILKVIEDKSYRDNIVRLRSLIQDQPQTPLERAIWWTEYVLRHGGAKHLRAPAANLSSTEYYEMELCLLISSVTLISAVLLFILIRLVVANVSKIIIPKQKLKSM

SEQ ID NO: 9170 - protein, 1023 aa, Anopheles gambiae
EQTAACTMLRTVILVALALSQGTEAYKVLGLFPHPGQSHFHFFQPVLKGLAEAGHEVTVVSHFPEKNPPANYHDLPLAGMTSLSDSVSFELFEYRPGFGHFMEFFMLYTWGKEACANALNSTAIQTVLDSKVQYDLILVEQFNSDCMLGIAHQLKAPYIGLSSCPLMPWHYERVGNPTLPAYIPALFMGYTERMDFSQRLANWITVQSFKALYSWFNDAAANKLLGERFGQGAIPDVRELQQRTAMMFVNQHYSLSGAKPLSPAVLEIGGIHIRDFRPLEADLQQLLDTADHGVIYISWGSMIRAETLPAEKRDAILKALGRFKQRVIWKWENETLPNQPSNVHIRKWLPQREILCHPKVRVFMSHGGLLGSSEAAYCGVPVVATPMYGDQYNNAAALANRGMGVVLAYEDITADSVYDALRKVLEPEAMEHAKQVSFSYRNRPQSPLESAVWWCEHVAATGGLPLAQSYSSELPWYSYHQFDVYIVTITFLILLIVLAIGSSSHGYRILGLFPHPGLSHFKVFHPIMRGLANDGHHVTVLSYFPDSDPVPNYHDLRFEGQEVLTNTFSLQDFTGRTFIDNFHEFHELVVWGMDSCKAALDSPAIDQILEAHRVAPFDLVVMEVFATDCMAGISWLLQVPLVGLSSCAIMPWHYDRVGLPDTPSYIPSEFSTFSEEMSFWQRFENWLVTRVVKHLYRIVQISDNRLLKEKFPNAAIPDVAEIVQNTSLILINQHYTLSGARPLVPAVVEIGGVHIQGEKPLPTKLQQIMDQSSNGVIVVSFGSVLKAATLPTAKRNAMLEAFERFDQQVVWKWEDELDNPPKNLYTQKWLPQRDVLCHKNVRLFVSHGGLLGVSEAVHCGVPVVVMPIYGDQFLNAAALVNRGAGVRMDYELVDNVTYIASCIGEGLSDRKRRMAQSLSRAYKTRPQIPLDLARWSIINVIENGAMEYERSYAPKLPWYIYYSLDVILVLLFAALTLVFGERLDPVAGFSVDSANHTHCTEGQNHADTPPKCTRKTRANRSYF

SEQ ID NO: 9171 - protein, 416 aa, Unknown
  Description of Unknown: Xanthomonadales bacterium sequence
MHVLMVSDVCFPRVNGVSTSIGTFRDSLTRQGHRCTVVAPDYGLRGVDTHVQRVPARPVPFDPEDRLMIPRRLRSVLERLDPGDVDVVHLQTPFVAHAVGLRWARRHGLPVLETCHTHFEEYFHHYLPLLPAGWLRAAARTLTRRQCNALDAVIVPSLAMRDVLAGYGVRSPVHVLPTGIDPSAFGHGDGAAFRRRHGLAADRPVLVHVGRIAHEKNLDLLLDVTHLLRRAIPDVVLLVAGDGPALGHCRARVQSLGLEAHVRFVGYLDRGGELQDCYRAGDLFVFASKTETQGLVMLEALALGVPVVAIPALGARDIVEPGRGAVPAPDDASAYAAIVAGLLRDPGRRAYLADEAVRFAREWDSTTVARRLVDVYAEVGVSRPRAPVNHAVAALHAADERNEPAQGVGSGAGPDH

SEQ ID NO: 9172 - protein, 322 aa, Enterococcus faecalis
MKIGFFTDTYFPQVSGVATSIKTLKDELEKHGHEVYIFTTTDPNATDFEEDVIRMPSVPFVSFKDRRVVVRGMWYAYLIAKELELDLIHTHTEFGAGILGKMVGKKMKIPVIHTYHTMYEDYLHYIAKGKVVRPSHVKFFSRVFTNHTTGVVCPSERVIEKLRDYGVTAPMRIIPTGIEIDKFLRPDITEEMIAGMRQQLGIEEQQIMLLSLSRISYEKNIQAIIQGLPQIIEKLPQTRLVIVGNGPYLEDLKELAEELEVSEYVQFTGEVPNEEVAIYYKAADYFVSASTSETQGLTYTEAMAAGVQCVAEGNAYLNNLFD

SEQ ID NO: 9173 - protein, 411 aa, Flagellimonas maritima
MKKTIVLLSALEPWSMKTGAGAPSLYETIKGYSDNGFQITYITYQKYVQKLNISHSQNIDLDLPGLNTLRVKKIKGPIFFGPRFLGKLNRLYYEPKTLLNALEDYLNNLEETPSILYAYEAQAVHAISMLKRKYKDKSIVVNRFQGTILGNRYREYFYCLRKYEMFRILRNKADKYIMTNDGTHGDEALKYWNANVNDNNLLFIRNGFNFQSFQKTKSRTATIGELGLDPKNFYAFTVSRLTYWKRVDRAIGLIEKFAKKHPKLHLIVVGEGEHKLDLIELAESKGVSDKVHFIGAQSREKVAELMQALDVFLSLYDVSNLGNPLFEAMICGQCIITLDNGTTKEVIEHNKNGIIVSPDNKSDLQKEFETLLMNEEKRIRLKKTAKAWAERNLQSWSNRMKKEIDWIQNGP

SEQ ID NO: 9174 - protein, 400 aa, Faecalicatena orotica
MRIALFSETYLPQINGVATHVKTLKEGMEALGHQVLVVTADPKAEVCHMKEGVLRCPAAELKDLYGYGMAPSYNLERMRLIQAFSPDIAHTHTEFGIGSTGLETARKLKIPFIYTLHTMWDDYLHYVASPTLQPVVRKMIHRYLRYFASQADAIIGPSVKSRDFLHHCGVKREIEVIPNAVELEQFSRDRTDPVTVKMLRQFYNIQNDDTVICFCGRLGQEKSVDVLIRFFAQCRQKEAHLKLLLIGDGPALSELKELTRRLNAGSAVIFTGAVPHESVREVYACSDLYATASRSEVNSISMLEAMSMGLPVLQRLDEANPGQVTVGVNGYVFRTAEEFSAILLRFRNSSHVGQARMQASTANSVKGLHPTGLARQMEAIYLRLATCRPASLNAWKEEVK

SEQ ID NO: 9175 - protein, 402 aa, Chrysanthemum yellows
MKIGFFTDTYLPIIGGIPISVKSHKDSLEKLGHKVYIITPQGPKNYEEKDASIIRIKGIPIPFKGIEGHRVVLRFKKYLSLVKDLNLDIIHIHTEFPMGKLGIYASQKLNIPSVYTMNTMHEYFFNKSKNIGIKIFKLFFILANRKALKKFFSKTHSTIVPTHKILTLLEKDYNIKGKYNVVPTGINLEQFYSQNHSLEEIQALKVKFNLVNDFVCLYVGRLSPEKDISYLISAFASFCQNHPQSKFVIVGDGPEKKALQKQVKQLQIENNVLFLGFVPYDNLVIYYQLGNCFLSASLFETQGLTFVEAMASSLVLLARHDQALDGLIDNGNNGFFYHQKEELINYLSLLYNDNKKTKTMSMNAKNSILNYDQTSFASKMIQIYKEAIKTNKENNNQNNNHN

SEQ ID NO: 9176 - protein, 397 aa, Friedmanniella luteola
MRILLGADQYPEYINGAATFTARLAGGLAARGHTVDLVWPSVDGRPHYGFDAGVRVHRVSSLRLPTSAAIRTSTPWAVSREVRAILGFARPDVVHVQSHFALGRALVRSAKAAGLPVLATNHFMPENLTHHVPLLRHASRPAARAAWNDLARVYRAADAITAPTERAVQLLAAATDLPRAEAVSCGIDLDRFRPAGPASVEPATLLFVGRLEQEKHVDDLLRAFARVPVTQGARLEVVGMGSQRAELEALARQLALAGRVLFRGAVSDDELLRAYQRATVFVMPGTAELQSLATLEAMAAGCPVVAADAMALPHLVGHGDNGYLVRPGDLPGLADALGALLADAPLRRRMGAASRARAARHQLTATLTAFEDRYAALSGLPLPTRVAPADAELLLAS

SEQ ID NO: 9177 - protein, 365 aa, Serratia plymuthica
MRILMIIDGLPGGGAEKVVLTLCQGMQELGNDVSLISLRDVCNYPIPAGVHYQVVADHSRTPWRKLTELSRRATALDRVIADNERRQGAYDLVFSNLHKTDRIVSRSKLLSSDRLWFCIHGMLSTSYLGHRKGMDRWLKQRKIADVYQGQNIVAVSQAVGDDLQQNLPIHPNRLAVINNPFDIAAIEQQAAEPCELAGQEYLVHVGRFHPHKRHDRLLKAYAQSGIQAPLALIGTGSEANVGEVKQLANQLGIADRVLFLGFQANPYPFIRHASLLVLSSDSEGFGNVLVEALLCGTPVVSTRCPGGPAEILEKAGMDNALADLNEKSLAEKMAKIHAQPPEINHQQLLSYGLKSICQRYLALKK

SEQ ID NO: 9178 - protein, 237 aa, Saliniradius amylolyticus
MIADQIVVVSKWWQNRIEKVYPELKDKIVVNQNGLSPVFLAKAMKEAHTPDSPSETVRVITMTRLLKKKGVQRVIEAMRFLPPEFHLSIAGTGPYVGELQKLSIKLQLESRIRFLGWLNEDEKIQQMKSHDVFAMPSEYDSFGMVFIEAMACGLPVVTTPSGPITDIVTNGIDGIIARSTDGEDIARAIEKAYQNCVSMADNARNNVSDNFRVESGARELVSLFSRMSGKSVDGQKN

SEQ ID NO: 9179 - protein, 363 aa, Halococcus morrhuae
MPPHVAAFTDTYLPTVNGVTYTIRTWHERWQRRDGRMDVVYPGADGHDPTPDEHPVRSLPFPFYENFRVGVPSVPDAVANADIVHAHTPFGLGLGGLRLAHDIDQPLVASYHTPTAEYAGYLAEGWLLDAVARVGNAYERWFLGRADHIVVPSETVRTALVNRGIGPVSVVSNGVDTDRFAPTDTADFRTRHDLPDGPLVGYTGRHGFEKELADLVATAEGMDATFVLAGDGPARKTLQEEANEIDADVRFLGFLDREELPQFYSALDVFGFPSPVETQGLVALEAMACGTPVVGVDSGALTETIDDGETGYHYEQGDIGAFRDALGRALADDELPATCRSRRESMSVEHSVDALASVYDTVL

SEQ ID NO: 9180 - protein, 350 aa, Vibrio parahaemolyticus
MKTKILHIINDLSQNGGAQKFLVDLVLEHNPEYEIKILVLCAENDYLEQLSAQGIQCFNWQTLSLSEKWSLLRWPDLVHGHLYPSIYLALLAIGKKRIQTEHCSYNRRRDYPLLKFIEYVLYWGHHYTVSISEKVQEELVKFMPRYQHKYRVVHNGVDLNRFPMTAKQAHNLSEKATINIGMVGRLHEHKDHETLIHAIAKLPECYHLHLAGDGDRKASLQRLAQSLNVLSRVHFHGVVSDIPLFLSDMDIYVQSSHVEGFGLAAVEAMAAGLPVLSSDVPGLNEVTGSSEYLFEVGDSNRLAQKVAELCEDAALYNSASHYSVNRAKLYTIDKFREGYYGIYQQLCTDK

SEQ ID NO: 9181 - protein, 332 aa, Unknown
  Description of Unknown: Actinobacteria bacterium sequence
NELVRRGHDVTLFAAGDSRTSARLVPVVDSPLWHHDPPYQDFAPFWAVVLDVLVDCWHEFDVIHSHLDYLAFPLARFAPCPLVTTLHGRLDLPELECLYGRFNDIPIVSISDAQRQPVPHANWVATAHHGVEVEEYTFDPVGGEYLAFLGRISPEKGLETAIAAARKSGLPLKVAAREPLPHDGDPSAQRDWEYYEREICPLLKAGDVEMIGPVRHADKNRLLGGAAALLFPIRWPEPFGLVMIEALACGTPVLAFNNGSVPEVLQHGVTGFICDSEDELVKNASRIRQIDRMRCRAEAEQRFSAEAMANQYERVYDSLLADAGPRAARRVV
